United States Patent
Fu et al.

(10) Patent No.: US 11,041,865 B2
(45) Date of Patent: Jun. 22, 2021

(54) BIOMARKERS OF MYOCARDIAL INJURY

(71) Applicants: THE JOHNS HOPKINS UNIVERSITY, Baltimore, MD (US); CEDARS-SINAI MEDICAL CENTER, Los Angeles, CA (US)

(72) Inventors: Qin Fu, Beverly Hills, CA (US); Jennifer Eileen Van Eyk, Los Angeles, CA (US); Vidya Venkatraman, Los Angeles, CA (US)

(73) Assignees: THE JOHNS HOPKINS UNIVERSITY, Baltimore, MD (US); CEDARS-SINAI MEDICAL CENTER, Los Angeles, CA (US)

(*) Notice: Subject to any disclaimer, the term of this patent is extended or adjusted under 35 U.S.C. 154(b) by 0 days.

(21) Appl. No.: 15/552,095

(22) PCT Filed: Feb. 22, 2016

(86) PCT No.: PCT/US2016/018931
§ 371 (c)(1),
(2) Date: Aug. 18, 2017

(87) PCT Pub. No.: WO2016/134365
PCT Pub. Date: Aug. 25, 2016

(65) Prior Publication Data
US 2018/0217162 A1    Aug. 2, 2018

Related U.S. Application Data

(60) Provisional application No. 62/118,796, filed on Feb. 20, 2015.

(51) Int. Cl.
*G01N 33/53* (2006.01)
*G01N 33/68* (2006.01)

(52) U.S. Cl.
CPC ..... *G01N 33/6893* (2013.01); *G01N 33/6848* (2013.01); *G01N 2333/46* (2013.01); *G01N 2333/4704* (2013.01); *G01N 2333/4722* (2013.01); *G01N 2333/79* (2013.01); *G01N 2333/908* (2013.01); *G01N 2333/916* (2013.01); *G01N 2440/00* (2013.01); *G01N 2800/324* (2013.01)

(58) Field of Classification Search
None
See application file for complete search history.

(56) References Cited

U.S. PATENT DOCUMENTS

| | | |
|---|---|---|
| 4,981,785 A | 1/1991 | Nayak |
| 5,242,828 A | 9/1993 | Bergstrom et al. |
| 5,270,163 A | 12/1993 | Gold et al. |
| 5,358,691 A | 10/1994 | Clark et al. |
| 5,370,163 A | 12/1994 | Owen |
| 5,475,096 A | 12/1995 | Gold et al. |
| 5,567,588 A | 10/1996 | Gold et al. |
| 5,595,877 A | 1/1997 | Gold et al. |
| 5,637,459 A | 6/1997 | Burke et al. |
| 5,660,985 A | 8/1997 | Pieken et al. |
| 5,670,637 A | 9/1997 | Gold et al. |
| 5,683,867 A | 11/1997 | Biesecker et al. |
| 5,696,249 A | 12/1997 | Gold et al. |
| 5,707,796 A | 1/1998 | Gold et al. |
| 5,719,060 A | 2/1998 | Hutchens et al. |
| 5,866,434 A | 2/1999 | Massey et al. |
| 5,885,530 A | 3/1999 | Babson et al. |
| 6,011,020 A | 1/2000 | Gold et al. |
| 6,090,545 A | 7/2000 | Wohlstadter et al. |
| 6,140,045 A | 10/2000 | Wohlstadter et al. |
| 6,159,750 A | 12/2000 | Edmonds |
| 6,207,369 B1 | 3/2001 | Wohlstadter et al. |
| 6,225,047 B1 | 5/2001 | Hutchens et al. |
| 6,319,670 B1 | 11/2001 | Sigal et al. |
| 6,329,209 B1 | 12/2001 | Wagner et al. |
| 6,362,011 B1 | 3/2002 | Massey et al. |
| 6,413,783 B1 | 7/2002 | Wohlstadter et al. |
| 6,537,749 B2 | 3/2003 | Kuimelis et al. |

(Continued)

FOREIGN PATENT DOCUMENTS

| | | |
|---|---|---|
| EP | 3259594 A1 | 12/2017 |
| WO | 200056934 A1 | 9/2000 |

(Continued)

OTHER PUBLICATIONS

Van Der Vekiens et al., Human and equine cardiovascular endocrinology: beware to compare, Cardiovascular Endocrinology 2013, vol. 2, No. 4, pp. 67-76. (Year: 2013).*

Torzewski et al., Animal Models of C-Reactive Protein, Hindawl Publishing Corporation, Mediators of Inflammation, vol. 2014, Article ID 683598, 2014, pp. 1-7. (Year: 2014).*

Kiewitz et al., S100A1, a New Marker for Acute Myocardial Ischemia, Biochemical and Biophysical Research Communications, 274, 2000, pp. 865-871. (Year: 2000).*

(Continued)

*Primary Examiner* — Gary Counts
(74) *Attorney, Agent, or Firm* — Linda B. Huber; Nixon Peabody LLP

(57) ABSTRACT

The present invention relates to the field of myocardial injury. More specifically, the present invention provides methods and compositions useful in the diagnosis, prognosis and/or assessment of myocardial injury. In a specific embodiment, a method comprises the steps of (a) diagnosing a subject as having myocardial injury based on the statistically significant over expression of one or more markers described herein compared to a baseline value, wherein the markers are measured in a biological sample obtained from the subject; and (b) treating the subject with one or more of an anti-thrombolysis agent, coronary bypass surgery or angioplasty.

20 Claims, 34 Drawing Sheets

Specification includes a Sequence Listing.

(56) References Cited

U.S. PATENT DOCUMENTS

| | | |
|---|---|---|
| 6,673,533 B1 | 1/2004 | Wohlstadter et al. |
| 6,858,383 B2 | 2/2005 | Sabbadini |
| 6,919,173 B2 | 7/2005 | Tsionsky et al. |
| 6,977,722 B2 | 12/2005 | Wohlstadter et al. |
| 7,036,946 B1 | 5/2006 | Mosier |
| 7,052,861 B2 | 5/2006 | Massey et al. |
| 7,288,410 B2 | 10/2007 | Tsionsky et al. |
| 7,491,540 B2 | 2/2009 | Tsionsky et al. |
| 7,497,997 B2 | 3/2009 | Glezer et al. |
| 8,497,078 B2 | 7/2013 | Van Eyk et al. |
| 2001/0021534 A1 | 9/2001 | Wohlstadter et al. |
| 2002/0086335 A1 | 7/2002 | Massey et al. |
| 2002/0137234 A1 | 9/2002 | Wohlstadter et al. |
| 2002/0138208 A1 | 9/2002 | Paulse et al. |
| 2002/0192950 A1 | 12/2002 | Lu |
| 2002/0193950 A1 | 12/2002 | Gavin et al. |
| 2003/0003460 A1 | 1/2003 | Sigal et al. |
| 2003/0004402 A1 | 1/2003 | Hitt |
| 2003/0055615 A1 | 3/2003 | Zhang |
| 2003/0113713 A1 | 6/2003 | Glezer et al. |
| 2003/0124572 A1 | 7/2003 | Umek et al. |
| 2004/0022677 A1 | 2/2004 | Wohlstadter et al. |
| 2005/0052646 A1 | 3/2005 | Wohlstadter et al. |
| 2005/0142033 A1 | 6/2005 | Glezer et al. |
| 2006/0019319 A1 | 1/2006 | Billadeau et al. |
| 2006/0172340 A1 | 8/2006 | Wohlstadter et al. |
| 2008/0261317 A1 | 10/2008 | Fifer et al. |
| 2009/0006339 A1 | 1/2009 | Carlucci |
| 2009/0065357 A1 | 3/2009 | Glezer et al. |
| 2009/0170121 A1 | 7/2009 | Tsionsky et al. |
| 2010/0093557 A1 | 4/2010 | Kumble |
| 2010/0190656 A1 | 7/2010 | Li et al. |
| 2012/0205535 A1* | 8/2012 | Lemoine ............ G01N 33/6848 250/282 |
| 2012/0231094 A1* | 9/2012 | Taguchi ............... C12Q 1/6827 424/725 |
| 2014/0045714 A1* | 2/2014 | Gerszten ............ G01N 33/6893 506/9 |

FOREIGN PATENT DOCUMENTS

| | | |
|---|---|---|
| WO | 200131580 A2 | 5/2001 |
| WO | 2003048768 A2 | 6/2003 |
| WO | 2008080126 A2 | 7/2008 |
| WO | 2009143519 A2 | 11/2009 |
| WO | 2012058313 A2 | 5/2012 |
| WO | 2016134365 A1 | 8/2016 |

OTHER PUBLICATIONS

Cao et al., Spatiotemporal Expression of Matrix Metalloproteinases (MMPs) is Regulated by the Ca2+ Signal Transducer S100A4 in the Pathogenesis of thoracic Aortic Aneurysm, PLOS One, Jul. 2013, vol. 8, Issue 7, pp. 1-10. (Year: 2013).*

Schneider et al., S100A4 is upregulated in injured myocardium and promotes growth and survivial of cardiac myocytes, Cardiovascular Research, 75, 2007, pp. 40-50 (Year: 2007).*

Shim et al., Serum Thioredoxin 1 Level has close relation with myocardial damage amount in Acute Myocardial Infarction Patients, J Korean Med Sci 2012, 27, pp. 1162-1169. (Year: 2012).*

Ademowo, O. et al. 'Biomarkers of inflammatory arthritis and proteomics', INTECH Open Access Publisher, 2013, internal pp. 237-267.

Radhakrishnan, D. et al. 'Translational research in pediatrics III: bronchoalveolar lavage', Pediatrics, 2014, vol. 134, No. 1 pp. 135-154.

Fu et al., An Empirical Approach to Signature Peptide choice for Selected Reaction Monitoring: Quantification of Uromodulin in Urine., Clin Chem (2016), 62(1), 168-207.

Ruczinski et al., Logic Regression, Journal of Computational and Graphical Statistics (2003), 12(3), 475-511.

Friedman., Regularized Discriminant Analysis, Journal of the American Statistical Association. (1989), 84(405), 165-175.

Freiman., Random Forests., Machine Learning (2001), 45, 5-32.

Jain et al., Statistical Pattern Recognition: A Review., IEEE Transactions on Pattern Analysis and Machine Intelligence (2000), 22(1).

Kohler, et al., Continuous Cultures of Fused Cells secreting antibody of predefined specificity., Nature (1975), 256, 495-7.

PCT/US2016/018931 International Search Report and Written Opinion dated Jul. 20, 2016, 3 pages.

PCT/US2016/018931 International Preliminary Report on Patentability dated Aug. 22, 2017, 12 pages.

Baoxia et al., Angiopoietin-1, Angiopoietin-2 and Myocardial Ischemia-Reperfusion Injury, Journal of Hypertension: Open Access, 2012, vol. 1, Issue: 3, pp. 1-2.

* cited by examiner

BIOMARKERS OF MYOCARDIAL INJURY

CROSS-REFERENCE TO RELATED APPLICATIONS

This application is a 35 U.S.C. § 371 U.S. national entry of International Application PCT/US2016/018931, having an international filing date of Feb. 22, 2016, which claims the benefit of U.S. Provisional Application No. 62/118,796, filed Feb. 20, 2015, the content of each of the aforementioned applications is herein incorporated by reference in their entirety.

STATEMENT REGARDING FEDERALLY SPONSORED RESEARCH OR DEVELOPMENT

This invention was made with government support under Grant No. HHSN268201000032C awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Dec. 4, 2017, is named P12557-03_SL.txt and is 764,203 bytes in size.

FIELD OF THE INVENTION

The present invention relates to the field of myocardial injury. More specifically, the present invention provides methods and compositions useful in the diagnosis, prognosis and/or assessment of myocardial injury.

BACKGROUND OF THE INVENTION

Cardiac injury is defined as the disruption of normal myocyte membrane integrity results in releasing of the myocyte cellular components into extracellular space including blood caused by insults to the heart. The cellular components include cytosolic and structure proteins such as troponin, creatine kinase, myoglobin and others. Cardiac injury is caused by ischemic or non-ischemia insults to the heart. The non-ischemic insults to the heart can be caused by trauma, toxin and viral infection. The ischemic (lack of oxygen) insults to the heart can be caused by reduced the blood flow to the heart and cause myocardium injury (re-versible and non-reversible). Physiologically, the decreased blood flow is caused by various abnormities and damages to the arterial, such as building up of atherosclerotic plaques in the arteries, narrowing or blockage of arteries in the heart, damage and/or rapture of heart arteries from atherosclerosis and thrombosis. When the body cannot pump enough oxygen-rich blood to the rest of the body, chest pain (angina) or a heart attack occurs (myocardium infarction). Acute Coronary Syndrome (ACS) refers to a group of heterogeneous coronary diseases that result from ischemic insults to the heart with different pathophysiology, clinical presentation, and risk for adverse events. ACS is manifestation of cardiac injury from ischemic, stable angina, unstable angina to myocardial infarction.

ASC, also known as myocardial (cardiac) injury or myocardial damage, represents about 20% of all deaths globally. The direct, treatment-related and management costs, as well as indirect, social and economic costs for ACS are estimated to be more than 150 billion. The proper diagnosis of ACS requires reliable and accurate biomarker tests. Currently, blood tests for the cardiac specific isoform of troponins (TnI or TnT, respectively) are generally used for the diagnosis of acute myocardial infarction. Creatine kinase (CK)-MB and myoglobin are considered to be less specific for cardiac injury.

It is important that ACS symptoms are recognized early and accurately, so patients can receive immediate and adequate medical attention. This will contribute to significantly reduced morbidity and mortality from ACS. At an earlier time point of MI in which the heart is in ischemia but is not yet in necrosis, it is this diagnosis of cardiac ischemia in the absence of necrosis that cannot currently be made with accuracy. It would be useful to be able to identify subjects in this diagnostic window (having non-necrotic ischemia). Such a diagnostic tool would be of great value for triage in the emergency department. It would allow for earlier intervention, including earlier perfusion, to allow increased salvage of the injured myocardium; and it would prevent unnecessary admittance to the hospital of patients with non-cardiac chest pain. Furthermore, such an assay could delay therapy in subjects who do not exhibit diagnostic electrocardiographic (ECG) changes, and could help to improve the accuracy of current provocative tests for ischemia, such as exercise stress testing. The sooner intervention can be carried out the less cardiac damage will occur. Less damage is correlated to increase long term survival.

Therefore, there is an urgent need in the art for a rapid, sensitive and specific, diagnostic assay for ischemic myocardium injury in ACS patients. Such assays also allow an early, accurate and differential diagnosis of MI in emergency room (ER), differentiate the types of ACS and identify individuals at risk for delayed adverse events.

SUMMARY OF THE INVENTION

The present invention is based, at least in part, on the identification and usage of diagnosis and/or prognosis cardiac injury markers for ACS including ischemia and/or necrosis. Currently, various tests have been used to detect myocardial events (particularly late occurring events, such as necrotic myocardial ischemia). The clinically available tests include determining the levels of cardiac specific isoform(s) of troponin I (TnI), and/or troponin T (TnT), or creatine kinase (CK-MB) or myoglobin. Only Tn I and TnT are the current gold standard, CK MB and myoglobin are not cardiac specific. The recent introduction of high sensitive Troponin assays allows for the detection of cardiac components in early stage of MI such as cardiac ischemia during first few hours of ER presentation.

However, there are several issues in the application of the gold standard Troponin assays and recent high-sensitive troponin assays in accessing cardiac injury: 1). clinical specificity for cardiac injury—the ultra-sensitive troponin assays also pick up miniscule amounts of troponin protein in older people, after strenuous or vigorous exercise like running marathons, and in people with subclinical hearing conditions; and 2). a small percentage of patients presenting at ER with negative troponin test will have life threatening cardiac events later.

Therefore, all current clinical tests are not completely satisfactory for accurate and differential diagnosis and prognosis of cardiac injury. There is a huge need to have additional markers/tests to provide specificity and differentiating underline pathophysiology in cardiac injury diagnosis and prognosis. The markers described here can be used in conjunction with other clinical available assays such high-sensitive troponin assays, myoglobin, CK-MB total and isoform types of assays.

The novelty of this invention is to monitor cardiac injury in three aspects:

A.) The present inventors identified markers for accurate and differential diagnosis and prognosis of cardiac injury. A panel of markers can be applied in multiple clinical settings.
  1). Identified markers allow for early, accurate and differential diagnosis of cardiac injury from cardiac ischemia to large MI. This will greatly facilitate the diagnosis of individuals presenting to the ER with chest pain.
  2). Identified markers allow accurate and differential evaluation of cardiacmyocytes injury in various acute and chronic cardiac diseases. Cardiovascular disease includes a number of conditions affecting the structures or function of the heart such as coronary artery disease (narrowing of the arteries), heart attack, abnormal heart rhythms or arrhythmias, heart failure, heart valve disease, congenital heart disease, heart muscle disease (cardiomyopathy), pericardial disease, aorta disease and Marfan syndrome and vascular disease (blood vessel disease).
  3). Identified markers facilitate differentiating the types of ACS and identify individuals at risk for delayed adverse events. The markers have prognostic value for disease management and risk stratification in ACS patients.
  4). Identified markers act as "rule-in" and/or "rule-out" markers to differentiate ischemic cardiac injury from non-ischemic cardiac injury.

B). Both antibody based immunosandwich assay and mass spectrometry based multiple reaction monitoring (MRM) assays listed markers can be used for monitoring cardiac injury markers in ACS patients for diagnosis, prognosis, disease management and risk stratification. The methods described provide quantitative measurement of identified markers.
  1). Materials and procedures relate to mass spectrometry based multiple reactions monitoring (MRM) quantitation method.
  2). Materials and procedures relate to antibody based immune assays.

Wherein a significant amount (e.g., at least a statistically significant amount) of over-expression of the protein(s) compared to the baseline value (or values normally observed in healthy individuals) is indicative of myocardial injury (e.g., indicates that the subject has, or is likely to have, myocardial ischemia). The amount of expression may be determined for any combination of class I and class II cardiac injury markers.

C) The present inventors identified post translational modification (PTM) together with quantitative information of the markers for accurate and differential diagnosis and prognosis of cardiac injury.

A panel of markers with specific PTM can be applied in multiple clinical settings.
  1). Identified post translational modification (PTM) together with quantitative information of the new marker will allow for early, accurate and differential diagnosis of cardiac injury from cardiac ischemia to large MI. This will greatly facilitate the diagnosis of individuals presenting to the ER with chest pain.
  2). Identified post translational modification (PTM) together with quantitative information of the markers will allow for accurate and differential evaluation of cardiacmyocytes injury in various acute and chronic cardiac diseases. Cardiovascular disease includes a number of conditions affecting the structures or function of the heart, such as coronary artery disease (narrowing of the arteries), heart attack, abnormal heart rhythms or arrhythmias, heart failure, heart valve disease, congenital heart disease, heart muscle disease (cardiomyopathy), pericardial disease, aorta disease and Marfan syndrome and vascular disease (blood vessel disease).
  3). Identified post translational modification (PTM) together with quantitative information of the new marker will facilitate differentiating the types of ACS and identify individuals at risk for delayed adverse events. The markers have prognostic value for disease management and risk stratification in ACS patients.
  4). Identified post translational modification (PTM) in together with quantitative information of the new marker act as "rule-in" and/or "rule-out" markers to differentiate ischemic cardiac injury from non-ischemic cardiac injury.

Another aspect of the invention relates to methods for identifying subjects that have myocardial injury that is induced by coronary blood vessel blockage which limits the supply of blood, comprising determining in the sample from the subject the amount, compared to a baseline value, of at least one of the proteins (intact or degradation or processed products) of class I or class II injury markers. The amount of expression may be determined for any combination of class I or II these proteins or in any order. In a method of the invention, a determination that increasing numbers of protein markers of the invention are overexpressed in a subject can further indicate that the subject has (or is likely to have) myocardial injury.

In further embodiments, a method may further comprise measuring in the sample the amount of one or more other markers that have been reported to be diagnostic of cardiac necrosis, including cardiac specific isoforms of troponin I (TnI) and/or troponin T (TnT), (although CK-MB, myoglobin have been used in the past, cTnI and cTnT are the current gold standards) wherein a significant increase (e.g., at least a statistically significant increase) of the one or more markers further is further indicative that the subject has myocardial injury.

Cardiac injury is a heterogeneous condition caused by a variety of underlying mechanisms. Even if a single marker of the invention is capable of detecting a subject having cardiac injury resulting from a particular mechanism, it is possible for some markers that the marker is also up-regulated in a disease other than myocardial injury. In such a case, it would be desirable to screen for up-regulation of at least one additional marker that is associated with cardiac injury caused by a different underlying mechanism.

Another aspect of the invention is a method for treating a subject suspected of having myocardial injury, comprising determining by a method as above if the subject has (or is likely to have) myocardial injury and, (1) if the subject is determined to have (or to be likely to have) myocardial injury, treating the subject aggressively [such as angioplasty (mechanical widening in opening blood vessels), or treated with an anti-thrombolysis agent (PCI, or TPA) or undergo coronary bypass surgery to replace the injured/blocked coronary artery], or (2) if the subject is determined not to have (or not to be likely to have) myocardial injury, treating the subject would be released from hospital (especially if not detectable cTnI or cTnT was present). This would allow the absence of the ischemic markers to be used as a rule out and allowing person to be release from care.

In another aspect, the present invention provides kits. In certain embodiments, a kit for detecting the presence of cardiac injury in a subject, comprises reagents for detecting the amounts of at least one marker described herein.

The present invention further provides methods for determining if a subject has myocardial ischemia, comprising (a) providing a sample obtained from a subject suspected of having myocardial ischemia; (b) determining in the sample the amount of at least one of the proteins in Tables 1-11; (c) comparing the amount(s) of the protein(s) to a baseline value (or healthy individual level) that is indicative of the amount of the protein in a subject that does not have myocardial ischemia, wherein an increased amount (e.g., a statistically significantly increased amount) of the protein(s) compared to the baseline value is indicative of myocardial ischemia. The method can also comprise generating a report summarizing the biomarker levels and the baseline values. In other embodiments, the method can further comprise indicating, recommending or otherwise listing a particular treatment modality.

In other embodiments, the method can further comprise (d) comparing the amount (s) of the proteins to a baseline over time, the kinetic rise and fall of proteins optionally in combination with known neurosis markers is indicative of impending myocardial injury (or other cardio and vascular events such as stroke). The method can further comprise (e) comparing the amount(s) of the PTMs of the protein(s) to a baseline value (or healthy individual level) that is indicative of the amount of the PTMs of the protein in a subject that does not have myocardial ischemia, wherein an increased amount (e.g., a statistically significantly increased amount) of the PTMs of protein(s) compared to the baseline value is indicative of myocardial ischemia. In certain embodiments, the method can further comprise (f) comparing the amount (s) of the PTMs of the proteins to a baseline over time, the kinetic rise and fall of the PTMs of the proteins optionally in combination with known neurosis markers is indicative of impending myocardial injury (or other cardio and vascular events such as stroke). It can also be used to determine risk in patients with stable and unstable angina.

Thus, the methods described herein include measuring the amounts (full length, isoforms, PTM forms or peptides thereof) over time. The methods further comprise comparing such amounts to a baseline value, wherein an increased or decreased amount compared to the baseline value is indicative of myocardial injury. The method can also comprise treating a subject with one or more of an anti-thrombolysis agent, coronary bypass surgery or angioplasty, wherein the subject was tested using a method described herein.

A sample which is "provided" can be obtained by the person (or machine) conducting the assay, or it can have been obtained by another, and transferred to the person (or machine) carrying out the assay.

This patent application is extension of the previous patent application (PCT/US2009/045168). The present invention 1). provides more markers; 2). provides broader utility of markers to general cardiac injury markers. 3). classifies the markers into cardiac injury markers (class I) and cardiac injury related markers (class II); 4). provides mass spectrometry based quantification assay MRM method for 18 cardiac injury markers; 5). provides data on various ACS cohorts including valve replacement cohort, ACS (TNI positive), CAD and normal individuals, Emergency Department MI, stable angina (SA), unstable angina (UA with Tni position and negative individuals). The future related work includes: 1). Develop MRM assay for the rest of cardiac injury markers; 2). Development antibody capture-mass spectrometry based quantification of cardiac injury markers with low concentrations; 3).Test them in various cohort.

Further embodiments of the present invention include:

1. An Emergency Department (ED) test of body fluids (blood, urine, etc.) to be administered to individuals presenting to the ER with chest pain;

2. A home chest pain test kit including these proteins and necrosis markers for blood and urine or any other body fluid. This would mean any patient released from an ED or cardiac ward who is at risk for another cardiac event over, for example, the next 48 hours would take test over that time at home and, if positive, return to ED;

3. The cardiac injury markers of clinical tests as well as home test kits to be performed for differential and specific diagnosis of cardiac abnormity; and 4). The cardiac injury markers of clinical tests and home test kits to monitor the health state of cardiac condition for risk stratification.

BRIEF DESCRIPTION OF THE FIGURES

FIG. 4 discloses SEQ ID NO: 1247.

FIG. 5 discloses SEQ ID NOS 1265, 1266 and 1265, respectively, in order of appearance.

FIG. 6 discloses SEQ ID NOS 1259 and 1259-1261, respectively, in order of appearance.

FIG. 7 discloses SEQ ID NOS 1262, 1264, 1262 and 1263, respectively, in order of appearance.

FIG. 8 discloses SEQ ID NOS 1250, 1252 and 1250-1251, respectively, in order of appearance.

FIG. 9 discloses SEQ ID NOS 1256, 1258 and 1256-1257, respectively, in order of appearance.

FIG. 10 discloses SEQ ID NOS 1253, 1247, 1249 and 1248, respectively, in order of appearance.

FIG. 11 discloses SEQ ID NOS 1253-1254, 1253 and 1255, respectively, in order of appearance.

FIG. 13 discloses SEQ ID NOS 1304-1305, respectively, in order of appearance.

FIG. 14 discloses SEQ ID NOS 1306-1308, respectively, in order of appearance.

FIG. 15 discloses SEQ ID NOS 1309-1312, respectively, in order of appearance.

FIG. 16 discloses SEQ ID NOS 1313-1315, respectively, in order of appearance.

FIG. 19 discloses SEQ ID NOS 1316-1318, respectively, in order of appearance.

FIG. 20 discloses SEQ ID NOS 1319 and 1317, respectively, in order of appearance.

FIG. 23 discloses SEQ ID NOS 1320-1323, respectively, in order of appearance.

FIG. 24 discloses SEQ ID NOS 1324-1325, respectively, in order of appearance.

FIG. 25 discloses SEQ ID NOS 1326-1329, respectively, in order of appearance.

FIG. 26 discloses SEQ ID NOS 1303 and 1330, respectively, in order of appearance.

FIG. 27 discloses SEQ ID NOS 1331-1333, respectively, in order of appearance.

FIG. 28 discloses SEQ ID NOS 1334-1335, respectively, in order of appearance.

FIG. 29 discloses SEQ ID NOS 1336-1337, respectively, in order of appearance.

FIG. 30 discloses SEQ ID NOS 1294 and 1338-1340, respectively, in order of appearance.

FIG. 31 discloses SEQ ID NOS 1341-1343, respectively, in order of appearance.

FIG. 32 discloses SEQ ID NOS 1291 and 1344-1347, respectively, in order of appearance.

DETAILED DESCRIPTION OF THE INVENTION

Figure 1:
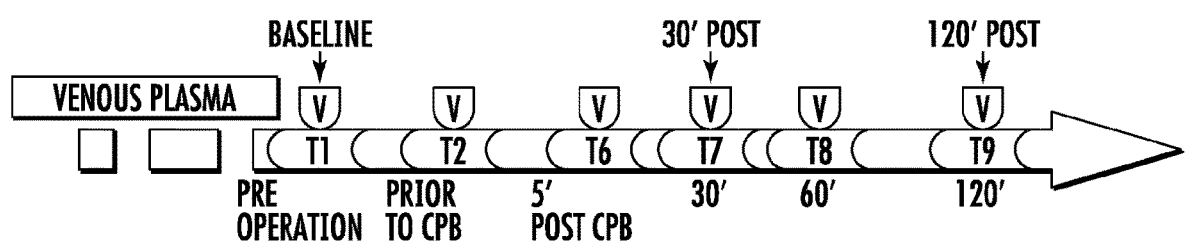
FIG. 1. Time points of plasma samples obtained from the valve replacement cohort.
Figure 2A:
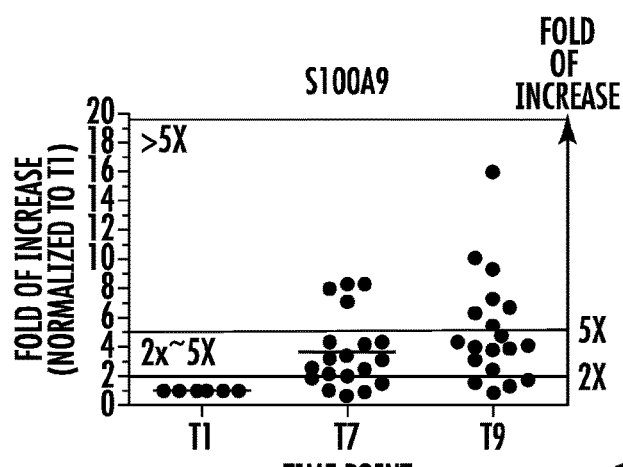
FIG. 2A-2D. Levels of S100A9, Peroxiredoxin-2 (PRD-2), Lactoferrin, and Lumican levels measured in plasma samples from the valve replacement cohort.
Figure 2B:
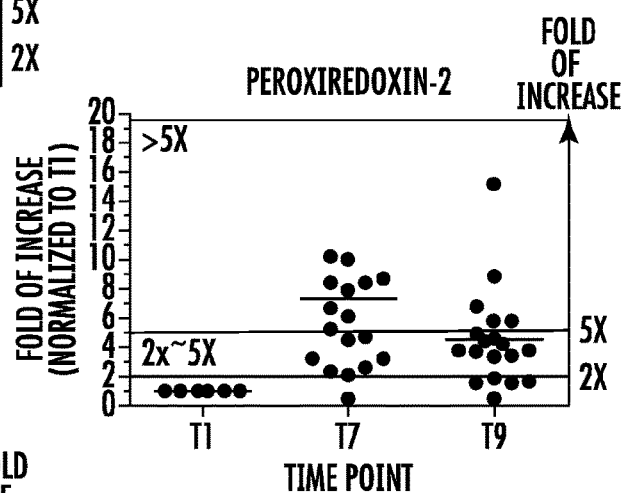
Figure 2C:
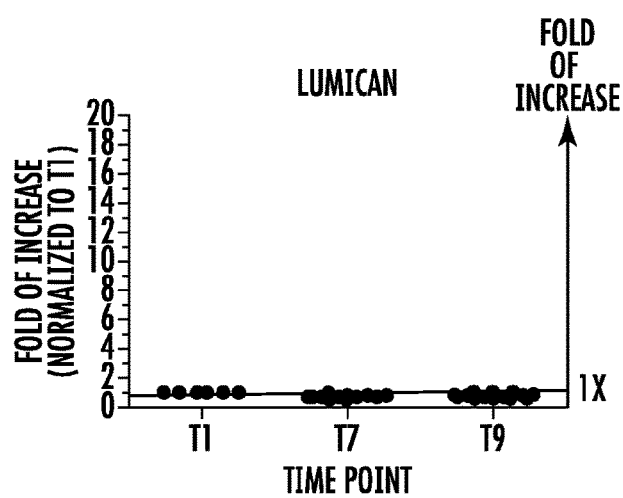
Figure 2D:
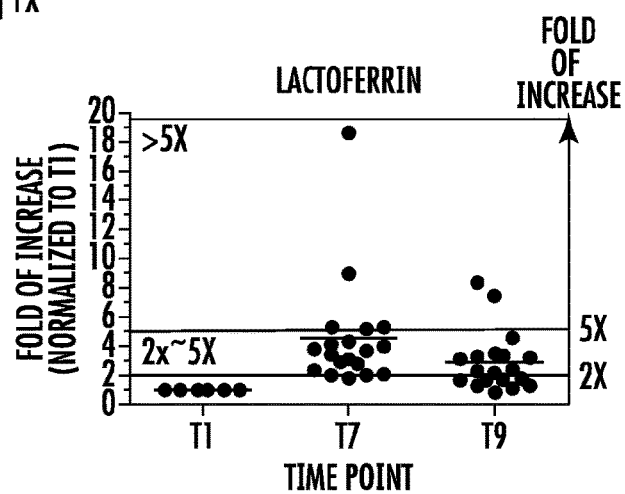

It is understood that the present invention is not limited to the particular methods and components, etc., described herein, as these may vary. It is also to be understood that the terminology used herein is used for the purpose of describing particular embodiments only, and is not intended to limit the scope of the present invention. It must be noted that as used herein and in the appended claims, the singular forms "a," "an," and "the" include the plural reference unless the context clearly dictates otherwise. Thus, for example, a reference to a "protein" is a reference to one or more proteins, and includes equivalents thereof known to those skilled in the art and so forth.

Unless defined otherwise, all technical and scientific terms used herein have the same meaning as commonly understood by one of ordinary skill in the art to which this invention belongs. Specific methods, devices, and materials are described, although any methods and materials similar or equivalent to those described herein can be used in the practice or testing of the present invention.

All publications cited herein are hereby incorporated by reference including all journal articles, books, manuals, published patent applications, and issued patents. In addition, the meaning of certain terms and phrases employed in the specification, examples, and appended claims are provided. The definitions are not meant to be limiting in nature and serve to provide a clearer understanding of certain aspects of the present invention.

I. Definitions

As used herein, the term "antibody" is used in reference to any immunoglobulin molecule that reacts with a specific antigen. It is intended that the term encompass any immunoglobulin (e.g., IgG, IgM, IgA, IgE, IgD, etc.) obtained from any source (e.g., humans, rodents, non-human primates, caprines, bovines, equines, ovines, etc.). Specific types/examples of antibodies include polyclonal, monoclonal, humanized, chimeric, human, or otherwise-human-suitable antibodies. "Antibodies" also includes any fragment or derivative of any of the herein described antibodies.

As used herein, the term "antigen" is generally used in reference to any substance that is capable of reacting with an antibody. More specifically, as used herein, the term "antigen" refers to a synthetic peptide, polypeptide, protein or fragment of a polypeptide or protein, or other molecule which elicits an antibody response in a subject, or is recognized and bound by an antibody.

As used herein, the term "biomarker" refers to a molecule that is associated either quantitatively or qualitatively with a biological change. Examples of biomarkers include polypeptides, proteins or fragments of a polypeptide or protein; and polynucleotides, such as a gene product, RNA or RNA fragment; and other body metabolites. In certain embodiments, a "biomarker" means a compound that is differentially present (i.e., increased or decreased) in a biological sample from a subject or a group of subjects having a first phenotype (e.g., having a disease or condition) as compared to a biological sample from a subject or group of subjects having a second phenotype (e.g., not having the disease or condition or having a less severe version of the disease or condition). A biomarker may be differentially present at any level, but is generally present at a level that is increased by at least 5%, by at least 10%, by at least 15%, by at least 20%, by at least 25%, by at least 30%, by at least 35%, by at least 40%, by at least 45%, by at least 50%, by at least 55%, by at least 60%, by at least 65%, by at least 70%, by at least 75%, by at least 80%, by at least 85%, by at least 90%, by at least 95%, by at least 100%, by at least 110%, by at least 120%, by at least 130%, by at least 140%, by at least 150%, or more; or is generally present at a level that is decreased by at least 5%, by at least 100%, by at least 15%, by at least 20%, by at least 25%, by at least 30%, by at least 35%, by at least 40%, by at least 45%, by at least 50%, by at least 55%, by at least 60%, by at least 65%, by at least 70%, by at least 75%, by at least 80%, by at least 85%, by at least 90%, by at least 95%, or by 100% (i.e., absent). A biomarker is preferably differentially present at a level that is statistically significant (e.g., a p-value less than 0.05 and/or a q-value of less than 0.10 as determined using, for example, either Welch's T-test or Wilcoxon's rank-sum Test).

In addition, the term "biomarker" also includes the isoforms and/or post-translationally modified forms of any of the foregoing. The present invention contemplates the detection, measurement, quantification, determination and the like of both unmodified and modified (e.g., glycosylation, citrullination, phosphorylation, oxidation or other post-translational modification) proteins/polypeptides/peptides. In certain embodiments, it is understood that reference to the detection, measurement, determination, and the like, of a biomarker refers detection of the protein/polypeptide/peptide (modified and/or unmodified).

The proteins and combinations of proteins discussed herein are sometimes referred to herein as "proteins (or protein markers) of the invention." The properties and amino acid sequences of the proteins of the invention are well-known and can be determined routinely, as well as downloaded from various known databases. See, e.g., International Protein Index (IPI) and Uniprot databases. A summary of some properties of some of the proteins discussed herein, including their IPI ID number and amino acid sequences, is provided. This information is accurate as of the date of filing of this application. However, some of this information, including the sequences, is routinely updated (e.g., to correct mistakes in the previous entries), so updated (corrected) information about the proteins is included in this application. Information provided in the IPI database is incorporated by reference in the present application.

Although much of the data presented in the Examples herein are directed to particular forms of proteins of interest (or peptides thereof), it will be evident to a skilled worker that a variety of forms of these proteins may be indicative of the presence of myocardial ischemia in a subject. For example, the protein may be an intact, full-length protein. If a protein undergoes processing naturally (e.g., is converted from a pre-pro-hormone to a pro-hormone to a fully processed hormone; the N-terminal methionine is cleaved off; the signal sequence is removed, often accompanied by a post-translational modification, such as acetylation; etc.), any of these forms of the protein are included in the invention. Furthermore, in some instances, a protein of the invention may be broken down or degraded (e.g., proteins that are found in the urine). In such a case, an investigator can determine the level of one or more of the fragments or degradation products. A "diagnostic protein fragment," as used herein, is a fragment that is unique to the protein being identified, as detected by the assay. For example, a diagnostic fragment is recognized specifically by an antibody used to detect the full-length protein. Certain isoforms or post translational modifications (PTM) may also be encompassed by the invention.

The term "one or more of" refers to combinations of various biomarker proteins. The term encompasses 1, 2, 3, 4, 5, 6, 7, 8, 9, 10, 11, 12, 13, 15, 16, 17, 18, 19, 20, 21, 22, 23, 24, 25, 26, 27, 28, 29, 30, 31, 32, 33, 34, 35, 36, 37, 38, 39, 40 . . . N, where "N" is the total number of biomarker proteins in the particular embodiment. The term also encompasses at least 1, at least 2, at least 3, at least 4, at least 5, at least 6, at least 7, at least 8, at least 9, at least 10, at least 11, at least 12, at least 13, at least 15, 16, 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40 . . . N. It is understood that the recitation of biomarkers herein includes the phrase "one or more of" the biomarkers and, in particular, includes the "at least 1, at least 2, at least 3" and so forth language in each recited embodiment of a biomarker panel.

As used herein, the terms "comparing" or "comparison" refers to making an assessment of how the proportion, level or cellular localization of one or more biomarkers in a sample from a patient relates to the proportion, level or cellular localization of the corresponding one or more biomarkers in a standard or control sample. For example, "comparing" may refer to assessing whether the proportion, level, or cellular localization of one or more biomarkers in a sample from a patient is the same as, more or less than, or different from the proportion, level, or cellular localization of the corresponding one or more biomarkers in standard or control sample. More specifically, the term may refer to assessing whether the proportion, level, or cellular localization of one or more biomarkers in a sample from a patient is the same as, more or less than, different from or otherwise corresponds (or not) to the proportion, level, or cellular localization of predefined biomarker levels/ratios that correspond to, for example, a patient having myocardial injury, not having myocardial injury, is responding to treatment for myocardial injury, is not responding to treatment for myocardial injury, is/is not likely to respond to a particular myocardial injury treatment, or having/not having another disease or condition. In a specific embodiment, the term "comparing" refers to assessing whether the level of one or more biomarkers of the present invention in a sample from a patient is the same as, more or less than, different from other otherwise correspond (or not) to levels/ratios of the same biomarkers in a control sample (e.g., predefined levels/ratios that correlate to uninfected individuals, standard myocardial injury levels/ratios, etc.).

In another embodiment, the terms "comparing" or "comparison" refers to making an assessment of how the proportion, level or cellular localization of one or more biomarkers in a sample from a patient relates to the proportion, level or cellular localization of another biomarker in the same sample. For example, a ratio of one biomarker to another from the same patient sample can be compared. In another embodiment, a level of one biomarker in a sample (e.g., a post-translationally modified biomarker protein) can be compared to the level of the same biomarker (e.g., unmodified biomarker protein) in the sample. Ratios of modified:unmodified biomarker proteins can be compared to other protein ratios in the same sample or to predefined reference or control ratios.

In embodiments in which the relationship of the biomarkers are described in terms of a ratio, the ratio can include 1-fold, 2-, 3-, 4-, 5-, 6-, 7-, 8-, 9-, 10-, 11-, 12-, 13-, 14-, 15-, 16-, 17-, 18-, 19-, 20-, 21-, 22-, 23-, 24-, 25-, 26-, 27-, 28-, 29-, 30-, 31-, 32-, 33-, 34-, 35-, 36-, 37-, 38-, 39-, 40-, 41-, 42-, 43-, 44-, 45-, 46-, 47-, 48-, 49-, 50-, 51-, 52-, 53-, 54-, 55-, 56-, 57-, 58-, 59-, 60-, 61-, 62-, 63-, 64-, 65-, 66-, 67-, 68-, 69-, 70-, 71-, 72-, 73-, 74-, 75-, 76-, 77-, 78-, 79-, 80-, 81-, 82-, 83-, 84-, 85-, 86-, 87-, 88-, 89-, 90-, 91-, 92-, 93-, 94-, 95-, 96-, 97-, 98-, 99-, 100-fold or more difference (higher or lower). Alternatively, the difference can include 0.9-fold, 0.8-fold, 0.7-fold, 0.7-fold, 0.6-fold, 0.5-fold, 0.4-fold, 0.3-fold, 0.2-fold, and 0.1-fold (higher or lower) depending on context. The foregoing can also be expressed in terms of a range (e.g., 1-5 fold/times higher or lower) or a threshold (e.g., at least 2-fold/times higher or lower).

As used herein, the terms "indicates" or "correlates" (or "indicating" or "correlating," or "indication" or "correlation," depending on the context) in reference to a parameter, e.g., a modulated proportion, level, or cellular localization in a sample from a patient, may mean that the patient has a myocardial injury or is otherwise suffering from neurodegeneration. In specific embodiments, the parameter may comprise the level of one or more biomarkers of the present invention. A particular set or pattern of the amounts of one or more biomarkers may indicate that a patient has a myocardial injury (i.e., correlates to a patient having myocardial injury). In other embodiments, a correlation could be the ratio of a post-translationally modified protein to the unmodified protein indicates (or a change in the ratio over time or as compared to a reference/control ratio) could mean that the patient has a myocardial injury).

In other embodiments, a particular set or pattern of the amounts of one or more biomarkers may be correlated to a patient being unaffected (i.e., indicates a patient does not have myocardial injury). In certain embodiments, "indicating," or "correlating," as used according to the present invention, may be by any linear or non-linear method of quantifying the relationship between levels/ratios of biomarkers to a standard, control or comparative value for the assessment of the diagnosis, prediction of myocardial injury or myocardial injury progression, assessment of efficacy of clinical treatment, identification of a patient that may respond to a particular treatment regime or pharmaceutical agent, monitoring of the progress of treatment, and in the context of a screening assay, for the identification of an anti-myocardial injury therapeutic.

A "subject," as used herein, includes any animal that has, or is suspected of having, a myocardial injury, for example, myocardial ischemia. Suitable subjects (patients) include laboratory animals (such as mouse, rat, rabbit, guinea pig or pig), farm animals, sporting animals (e.g., dogs or horses) and domestic animals or pets (such as a horse, dog or cat). Non-human primates and human patients are included. For example, human subjects who present with chest pain or other symptoms of cardiac distress, including, e.g., shortness of breath, nausea, vomiting, sweating, weakness, fatigue, or palpitations, can be evaluated by a method of the invention. About ¼ of myocardial infarction (MI) are silent and without chest pain. Furthermore, patients who have been evaluated in an emergency room or in an ambulance or physician's office and then dismissed as not being ill according to current tests for infarction have an increased risk of having a heart attack in the next 24-48 hours; such patients can be monitored by a method of the invention to determine if and when they begin express markers of the invention, which indicates that, e.g., they are beginning to exhibit ischemia. Subjects can also be monitored by a method of the invention to improve the accuracy of current provocative tests for ischemia, such as exercise stress testing. An individual can be monitored by a method of the invention during exercise stress tests or Dobutamine stress tests to determine if the individual is at risk for ischemia; such monitoring can supplement or replace the test that is currently carried out. Athletes (e.g., humans, racing dogs or race horses) can be monitored during training to ascertain if they are exerting themselves too vigorously and are in danger of undergoing an MI.

The terms "measuring" and "determining" are used interchangeably throughout, and refer to methods which include obtaining or providing a patient sample and/or detecting the level of a biomarker(s) in a sample. In one embodiment, the terms refer to obtaining or providing a patient sample and detecting the level of one or more biomarkers in the sample. In another embodiment, the terms "measuring" and "determining" mean detecting the level of one or more biomarkers in a patient sample. The term "measuring" is also used interchangeably throughout with the term "detecting." In certain embodiments, the term is also used interchangeably with the term "quantitating."

The terms "sample," "patient sample," "biological sample," and the like, encompass a variety of sample types obtained from a patient, individual, or subject and can be used in a diagnostic, prognostic and/or monitoring assay. The patient sample may be obtained from a healthy subject, a diseased patient or a patient having associated symptoms of myocardial injury. In particular embodiments, a "sample" (e.g., a test sample) from a subject refers to a sample that might be expected to contain elevated levels of the protein markers of the invention in a subject having myocardial ischemia. In certain embodiments, a sample that is "provided" can be obtained by the person (or machine) conducting the assay, or it can have been obtained by another, and transferred to the person (or machine) carrying out the assay.

Moreover, a sample obtained from a patient can be divided and only a portion may be used for diagnosis. Further, the sample, or a portion thereof, can be stored under conditions to maintain sample for later analysis. The definition specifically encompasses blood and other liquid samples of biological origin (including, but not limited to, peripheral blood, serum, plasma, cord blood, amniotic fluid, cerebrospinal fluid, urine, saliva, stool and synovial fluid), solid tissue samples such as a biopsy specimen or tissue cultures or cells derived therefrom and the progeny thereof. In certain embodiment, a sample comprises cerebrospinal fluid. In a specific embodiment, a sample comprises a blood sample. In another embodiment, a sample comprises a plasma sample. In yet another embodiment, a serum sample is used.

In another embodiment, the sample is urine, sweat, or another body fluid into which proteins are sometimes removed from the blood stream. In the case of urine, for example, the protein is likely to be broken down, so diagnostic fragments of the proteins of the invention can be screened for by appropriate methods. In another embodiment, the sample is cardiac tissue, which is harvested, e.g., after a heart transplant or the insertion of a pacemaker or defibrillator. Methods for obtaining samples and preparing them for analysis (e.g., for detection of the amount of protein) are conventional and well-known in the art.

The definition of "sample" also includes samples that have been manipulated in any way after their procurement, such as by centrifugation, filtration, precipitation, dialysis, chromatography, treatment with reagents, washed, or enriched for certain cell populations. The terms further encompass a clinical sample, and also include cells in culture, cell supernatants, tissue samples, organs, and the like. Samples may also comprise fresh-frozen and/or formalin-fixed, paraffin-embedded tissue blocks, such as blocks prepared from clinical or pathological biopsies, prepared for pathological analysis or study by immunohistochemistry.

Various methodologies of the instant invention include a step that involves comparing a value, level, feature, characteristic, property, etc. to a "suitable control," referred to interchangeably herein as an "appropriate control," a "control sample," a "reference" or simply a "control." A "suitable control," "appropriate control," "control sample," "reference" or a "control" is any control or standard familiar to one of ordinary skill in the art useful for comparison purposes. A "reference level" of a biomarker means a level of the biomarker that is indicative of a particular disease state, phenotype, or lack thereof, as well as combinations of disease states, phenotypes, or lack thereof. A "positive" reference level of a biomarker means a level that is indicative of a particular disease state or phenotype. A "negative" reference level of a biomarker means a level that is indicative of a lack of a particular disease state or phenotype. For example, a "myocardial injury-positive reference level" of a biomarker means a level of a biomarker that is indicative of a positive diagnosis of myocardial injury in a subject, and a "myocardial injury-negative reference level" of a biomarker means a level of a biomarker that is indicative of a negative diagnosis of myocardial injury in a subject. A "reference level" of a biomarker may be an absolute or relative amount or concentration of the biomarker, a presence or absence of the biomarker, a range of amount or concentration of the biomarker, a minimum and/or maximum amount or concentration of the biomarker, a mean amount or concentration of the biomarker, and/or a median amount or concentration of the biomarker; and, in addition, "reference levels" of combinations of biomarkers may also be ratios of absolute or relative amounts or concentrations of two or more biomarkers with respect to each other. Appropriate positive and negative reference levels of biomarkers for a particular disease state, phenotype, or lack thereof may be determined by measuring levels of desired biomarkers in one or more appropriate subjects, and such reference levels may be tailored to specific populations of subjects (e.g., a reference level may be age-matched so that comparisons may be made between biomarker levels in samples from subjects of a certain age and reference levels for a particular disease state, phenotype, or lack thereof in a certain age group). Such reference levels may also be tailored to specific techniques that are used to measure levels of biomarkers in biological samples (e.g., LC-MS, GC-MS, ELISA, PCR, etc.), where the levels of biomarkers may differ based on the specific technique that is used.

In one embodiment, a "suitable control" or "appropriate control" is a value, level, feature, characteristic, property, etc., determined in a cell, organ, or patient, e.g., a control or normal cell, organ, or patient, exhibiting, for example, normal traits. For example, the biomarkers of the present invention may be assayed for levels/ratios in a sample from an unaffected individual (UI) or a normal control individual (NC) (both terms are used interchangeably herein). For example, a "suitable control" or "appropriate control" can be a value, level, feature, characteristic, property, ratio, etc. determined prior to performing a therapy (e.g., myocardial injury treatment) on a patient or a value, level, feature, characteristic, property, ratio, etc. determined prior to injury (e.g., a baseline test). In yet another embodiment, a transcription rate, mRNA level, translation rate, protein level/ratio, biological activity, cellular characteristic or property, genotype, phenotype, etc., can be determined prior to, during, or after administering a therapy into a cell, organ, or patient. In a further embodiment, a "suitable control" or "appropriate control" is a predefined value, level, feature, characteristic, property, ratio, etc. A "suitable control" can be a profile or pattern of levels/ratios of one or more biomarkers of the present invention that correlates to myocardial injury, to which a patient sample can be compared. The patient sample can also be compared to a negative control, i.e., a profile that correlates to not having myocardial injury.

As used herein, the term "predetermined threshold value of expression" of a biomarker refers to the level of expression of the same biomarker (expressed, for example, in ng/ml) in a corresponding control/normal sample or group of control/normal samples obtained from normal, or healthy, subjects, i.e., subject who do not have myocardial injury. Further, the term "altered level of expression" of a biomarker in a sample refers to a level that is either below or above the predetermined threshold value of expression for the same biomarker and thus encompasses either high (increased) or low (decreased) expression levels.

When the values of more than one protein are being analyzed, a statistical method such as multi-variant analysis or principal component analysis (PCA) can be used which takes into account the levels of the various proteins (e.g., using a linear regression score). For verification, an immunoassay or multiple reaction monitoring (MRM, a MS-based targeted method that quantifies peptides that are unique to the protein of interest) can be used on individuals (control, ischemia and MI).

In some embodiments, it is desirable to express the results of an assay in terms of an increase (e.g., a statistically significant increase) in a value (or combination of values) compared to a baseline value. A "significant" increase in a value, as used herein, can refer to a difference which is reproducible or statistically significant, as determined using statistical methods that are appropriate and well-known in the art, generally with a probability value of less than five percent chance of the change being due to random variation. In general, a statistically significant value is at least two standard deviations from the value in a "normal" healthy control subject. Suitable statistical tests will be evident to a skilled worker. For example, a significant increase in the amount of a protein compared to a baseline value can be about 50%, 2-fold, or higher. A significantly elevated amount of a protein of the invention compared to a suitable baseline value, then, is indicative that a test subject has, for example, myocardial ischemia (indicates that the subject is likely to have, for example, myocardial ischemia). A subject is "likely" to have myocardial injury, e.g., myocardial ischemia, if the subject has levels of the marker protein(s) and/or PTMs significantly above those of a healthy control or his own baseline (taken at an earlier time point). The extent of the increased levels correlates to the % chance. For example, the subject can have greater than about a 50% chance, e.g., greater than about 70%, 80% 90%, 95% or higher chance, of having the ischemia. In general, the presence of an elevated amount of a marker of the invention is a strong indication that the subject has ischemia. Although several embodiments are mentioned in the context of myocardial ischemia, it is understood that the methods and compositions of the present invention apply to other forms of myocardial injury.

As used herein, a "baseline value" generally refers to the level (amount) of a protein in a comparable sample (e.g., from the same type of tissue as the tested tissue, such as blood or serum), from a "normal" healthy subject that does not exhibit myocardial ischemia. If desired, a pool or population of the same tissues from normal subjects can be used, and the baseline value can be an average or mean of the measurements. Suitable baseline values can be determined by those of skill in the art without undue experimentation. Suitable baseline values may be available in a database compiled from the values and/or may be determined based on published data or on retrospective studies of patients' tissues, and other information as would be apparent to a person of ordinary skill implementing a method of the invention. Suitable baseline values may be selected using statistical tools that provide an appropriate confidence interval so that measured levels that fall outside the standard value can be accepted as being aberrant from a diagnostic perspective, and predictive of ischemia.

It is generally not practical in a clinical or research setting to use patient samples as sources for baseline controls. Therefore, one can use any of variety of reference values in which the same or a similar level of expression is found as in a subject that does not have myocardial ischemia.

It will be appreciated by those of skill in the art that a baseline or normal level need not be established for each assay as the assay is performed but rather, baseline or normal levels can be established by referring to a form of stored information regarding a previously determined baseline levels for a given protein or panel of proteins, such as a baseline level established by any of the above-described methods. Such a form of stored information can include, for example, a reference chart, listing or electronic file of population or individual data regarding "normal levels" (negative control) or positive controls; a medical chart for the patient recording data from previous evaluations; a receiver-operator characteristic (ROC) curve; or any other source of data regarding baseline levels that is useful for the patient to be diagnosed. In one embodiment of the invention, the amount of the proteins in a combination of proteins, compared to a baseline value, is expressed as a linear regression score, as described, e.g., in Irwin, in Neter, Kutner, Nachtsteim, Wasserman (1996) Applied Linear Statistical Models, 4.sup.th edition, page 295.

In an embodiment in which the progress of a treatment is being monitored, a baseline value can be based on earlier measurements taken from the same subject, before the treatment was administered.

The terms "specifically binds to," "specific for," and related grammatical variants refer to that binding which occurs between such paired species as enzyme/substrate, receptor/agonist, antibody/antigen, and lectin/carbohydrate which may be mediated by covalent or non-covalent interactions or a combination of covalent and non-covalent interactions. When the interaction of the two species produces a non-covalently bound complex, the binding which occurs is typically electrostatic, hydrogen-bonding, or the result of lipophilic interactions. Accordingly, "specific binding" occurs between a paired species where there is interaction between the two which produces a bound complex having the characteristics of an antibody/antigen or enzyme/substrate interaction. In particular, the specific binding is characterized by the binding of one member of a pair to a particular species and to no other species within the family of compounds to which the corresponding member of the binding member belongs. Thus, for example, an antibody typically binds to a single epitope and to no other epitope within the family of proteins. In some embodiments, specific binding between an antigen and an antibody will have a binding affinity of at least $10^{-6}$ M. In other embodiments, the antigen and antibody will bind with affinities of at least $10^{-7}$ M, $10^{-8}$ M to $10^{-9}$ M, $10^{-10}$ M, $10^{-11}$ M, or $10^{-12}$ M. As used herein, the terms "specific binding" or "specifically binding" when used in reference to the interaction of an antibody and a protein or peptide means that the interaction is dependent upon the presence of a particular structure (i.e., the epitope) on the protein.

As used herein, the terms "binding agent specific for" or "binding agent that specifically binds" refers to an agent that binds to a biomarker and does not significantly bind to unrelated compounds. Examples of binding agents that can be effectively employed in the disclosed methods include, but are not limited to, proteins and antibodies, such as monoclonal or polyclonal antibodies, or antigen-binding fragments thereof. In certain embodiments, a binding agent binds a biomarker (e.g., a polypeptide biomarker) with an affinity constant of, for example, greater than or equal to about $1 \times 10^{-6}$ M.

II. Detection of Myocardial Injury Biomarkers

A variety of tests have been used to detect myocardial events (particularly late occurring events, such as necrotic myocardial ischemia). These include, e.g., determining the levels of cardiac specific isoform(s) of troponin I (TnI) and/or troponin T (TnT), CK-MB (Creatine Kinase-MB), or myoglobin, although only the former two are the current gold standard. CK MB and myoglobin are not cardiac-specific. However, none of these markers is completely satisfactory for the detection of myocardial ischemia. For example, they fail to detect early stages of heart disease, such as non-necrotic myocardial ischemia. The new markers described herein can be used in conjunction with these types of assays.

The amount of a protein can be measured using any suitable method. Some methods involve the use of antibodies, binding ligands, or mass spectrometry tagged peptides specific for a protein of interest. Antibodies suitable for use in assays of the invention are commercially available, or can be prepared routinely. Methods for preparing and using antibodies in assays for proteins of interest are conventional, and are described, e.g., in Green et al., Production of Polyclonal Antisera, in immunochemical Protocols (Manson, ed.), (Humana Press 1992); Coligan et al., in Current Protocols in Immunology, Sec. 2.4.1 (1992); Kohler & Milstein (1975), Nature 256, 495; Coligan et al., sections 2.5.1-2.6.7; and Harlow et al., Antibodies: A Laboratory Manual, page 726 (Cold Spring Harbor Laboratory Pub. 1988).

A. Detection by Immunoassay

In particular embodiments, the biomarkers of the present invention can be detected and/or measured by immunoassay. Immunoassay requires biospecific capture reagents/binding agent, such as antibodies, to capture the biomarkers. Many antibodies are available commercially. Antibodies also can be produced by methods well known in the art, e.g., by immunizing animals with the biomarkers. Biomarkers can be isolated from samples based on their binding characteristics. Alternatively, if the amino acid sequence of a polypeptide biomarker is known, the polypeptide can be synthesized and used to generate antibodies by methods well-known in the art.

The present invention contemplates traditional immunoassays including, for example, sandwich immunoassays including ELISA or fluorescence-based immunoassays, immunoblots, Western Blots (WB), as well as other enzyme immunoassays. Nephelometry is an assay performed in liquid phase, in which antibodies are in solution. Binding of the antigen to the antibody results in changes in absorbance, which is measured. In a SELDI-based immunoassay, a biospecific capture reagent for the biomarker is attached to the surface of an MS probe, such as a pre-activated protein chip array. The biomarker is then specifically captured on the biochip through this reagent, and the captured biomarker is detected by mass spectrometry.

In certain embodiments, the expression levels of the biomarkers employed herein are quantified by immunoassay, such as enzyme-linked immunoassay (ELISA) technology. In specific embodiments, the levels of expression of the biomarkers are determined by contacting the biological sample with antibodies, or antigen binding fragments thereof, that selectively bind to the biomarkers; and detecting binding of the antibodies, or antigen binding fragments thereof, to the biomarkers. In certain embodiments, the binding agents employed in the disclosed methods and compositions are labeled with a detectable moiety.

For example, the level of a biomarker in a sample can be assayed by contacting the biological sample with an antibody, or antigen binding fragment thereof, that selectively binds to the target biomarker (referred to as a capture molecule or antibody or a binding agent), and detecting the binding of the antibody, or antigen-binding fragment thereof, to the biomarker. The detection can be performed using a second antibody to bind to the capture antibody complexed with its target biomarker. A target biomarker can be an entire protein, or a variant or modified form thereof. Kits for the detection of biomarkers as described herein can include pre-coated strip plates, biotinylated secondary antibody, standards, controls, buffers, streptavidin-horse radish peroxidase (HRP), tetramethyl benzidine (TMB), stop reagents, and detailed instructions for carrying out the tests including performing standards.

In one embodiment of the invention, antibodies specific for a (one or more) protein of the invention are immobilized on a surface (e.g., are reactive elements on an array, such as a microarray, or are on another surface, such as used for surface plasmon resonance (SPR)-based technology, such as Biacore), and proteins in the sample are detected by virtue of their ability to bind specifically to the antibodies. Alternatively, proteins in the sample can be immobilized on a surface, and detected by virtue of their ability to bind specifically to the antibodies. Methods of preparing the surfaces and performing the analyses, including conditions effective for specific binding, are conventional and well-known in the art.

In one embodiment, a tissue sample (e.g., a cardiac tissue sample) is stained with a suitable antibody in a conventional immunohistochemical assay for those proteins which are present in the myocardium. Note that it can be difficult to obtain human tissue unless an individual is undergoing surgery or a routine biopsy (e.g., following heart transplantation), and such subjects are likely to be ischemic to some degree.

The present disclosure also provides methods for identifying which patients have myocardial injury, diagnosing myocardial injury in a subject, etc. wherein the levels of expression of the biomarkers in a biological sample are determined simultaneously. For example, in one embodiment, methods are provided that comprise: (a) contacting a biological sample obtained from the subject with a plurality of binding agents that selectively bind to a plurality of biomarkers disclosed herein for a period of time sufficient to form binding agent-biomarker complexes; (b) detecting binding of the binding agents to the plurality of biomarkers, thereby determining the levels of expression of the biomarkers in the biological sample; and (c) comparing the levels of expression of the plurality of biomarkers in the biological sample with predetermined threshold values, wherein levels of expression of at least one of the plurality of polypeptide biomarkers above the predetermined threshold values indicates, for example, a myocardial injury in the subject. Examples of binding agents that can be effectively employed in such methods include, but are not limited to, antibodies or antigen-binding fragments thereof, aptamers, lectins and the like.

In a further aspect, the present disclosure provides compositions that can be employed in the disclosed methods. In certain embodiments, such compositions a solid substrate and a plurality of binding agents immobilized on the substrate, wherein each of the binding agents is immobilized at a different, indexable, location on the substrate and the binding agents selectively bind to a plurality of biomarkers disclosed herein. In a specific embodiment, the locations are pre-determined. In one embodiment, the binding agents selectively bind to a plurality of biomarkers comprising one or more of GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelcidin antimicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FL175188, highly similar to *Homo sapiens* matrillin 2, transcript variant 2, mRNA, SAA, sICAM, sVCAM, CRP, NTproBNP, IFNg, IL-12p70, IL-1b, EMC, and LUM. In other embodiments, such compositions additionally comprise binding agents that selectively bind to other myocardial injury biomarkers. Binding agents that can be employed in such compositions include, but are not limited to, antibodies, or antigen-binding fragments thereof, aptamers, lectins and the like.

Binding agents can include agents that specifically bind post-translationally modified peptides of the foregoing. The PTMS include, for example, citrullination, phosphorylation and oxidation. Post translational modification of carbonic anhydrase 1 (CA1) can include citrullination (ESISVSSE-QLAQFR[157] (SEQ ID NO:1), SLLSNVEGD-NAVPMQHNNR[157]PTQPLK (SEQ ID NO:2)). PTM of CAT includes citrullination (NAIHTFVQSGSHLAAR[157] (SEQ ID NO:3)) and oxidation (M) (HM[147]N[115]GYGSHTFK (SEQ ID NO:4)). PTM of properdin (CFP) can include oxi (M) (YPPTVSM[147]VEGQGEK (SEQ ID NO:5)). PTM of desmoplakin (DSP) can include citrullination (IGLVR[157]PGTALELLEAQAATGFIVDPVSNLR (SEQ ID NO:6)). PTM of extracellular matrix protein 1 (ECM1) can include citrullination (DILTIDIGR[157] (SEQ ID NO:7), LVWEEAMSR[157] (SEQ ID NO:8), NLPATDPLQR[157] (SEQ ID NO:9), QGETLNFLEI-GYSR[157](SEQ ID NO:10), QHVVYGPWNLPQSSYS-HLTR[157] (SEQ ID NO:11)) and citrullination and phosphorylation (Q[129]HVVYGPWN[115]LPQ[129]S[167]S[167]Y[243]S[167]HLT[181]R[157](SEQ ID NO:12)). PTM of lactoferrin (LTF) can include citrullination (IDSG-LYLGSGYFTAIQNLR[157] (SEQ ID NO:13)), VPSHAV-VAR[157] (SEQ ID NO:14)) and phosphorylation (S[167]DT[181]S[167]LT[181]W[202]N[115]S[I67]VK (SEQ ID NO:15)). PTM of Lumican (LUM) can include citrullination (FN[115]ALQ[129]YLR[157](SEQ ID NO:16), FNALQYLR[157] (SEQ ID NO:17), SLEYLDLSFNQIAR [157] (SEQ ID NO:18)). PTM of Myosin-7 (MYH7) can include oxidation (M) (IEDMAM[147]LTFLHEP-AVLYNLK(SEQ ID NO:19)). Peroxiredoxin-2 (PRD2) PTMs include citrullination (EGGLGPLNIPLLADVTR [157](SEQ ID NO:20), R[157]LSEDYGVLK(SEQ ID NO:21), TDEGIAYR[157] (SEQ ID NO:22)). S100A7: Oxidation(M) (SIIGM[147]IDM[147]FHK (SEQ ID NO:23), SIIGMIDM[147]FHK) (SEQ ID NO:24); Phosphorylatio (Q[112]S[167]HGAAPCS[167]GGS[167]Q[129] (SEQ ID NO:25)). PTM of S100A9 can include oxidation(M) (QLS-FEEFIM[147]LMAR (SEQ ID NO:26)). PTM of SAA can include citrullination (FFGHGAEDSLADQAANEWGR [157](SEQ ID NO:27), GPGGVWAAEAISDAR[157] (SEQ ID NO:28)). PTM of semenogelin-1 (SEMG1) can include citrullination (HLAQHLNNDR[157] (SEQ ID NO:29), HLGGSQQLLHNKQEGR[157] (SEQ ID NO:30)) and citrullination and phosphoryaltion (GES[167]GQ[129]S[167]T[181]N[115]R[157] (SEQ ID NO:31)).

In a related aspect, methods for diagnosing the presence of myocardial injury in a subject are provided, such methods comprising: (a) contacting a biological sample obtained from the subject with a composition disclosed herein for a period of time sufficient to form binding agent-polypeptide biomarker complexes; (b) detecting binding of the plurality of binding agents to the plurality of polypeptide biomarkers, thereby determining the levels of expression of the plurality of polypeptide biomarkers in the biological sample; and (c) comparing the levels of expression of the plurality of polypeptide biomarkers in the biological sample with predetermined threshold values, wherein levels of expression of at least two of the plurality of polypeptide biomarkers above the predetermined threshold values indicates the presence of myocardial injury in the subject. In another embodiment, the method comprises d). comparing the PTMs of the plurality of polypeptide biomarkers in the biological sample with predetermined threshold values, wherein PTMs of expression of at least two of the plurality of polypeptide biomarkers above the predetermined threshold indicates the presence of myocardial injury in the subject.

In yet another aspect, the present disclosure provides compositions comprising a solid substrate and a plurality of polypeptide biomarkers disclosed herein immobilized on the substrate, wherein each of the polypeptide biomarkers is immobilized at a different, indexable, location on the substrate. In certain embodiments, the plurality of polypeptide biomarkers includes one or more of GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelcidin antibmicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FL175188, highly similar to *Homo sapiens* matrillin 2, transcript variant 2, mRNA, SAA, sICAM, sVCAM, CRP, NTproBNP, IFNg, IL-12p70, IL-1b, EMC, and LUM. In other embodiments, the plurality of polypeptide biomarkers further includes at least one polypeptide biomarker selected from the group consisting of GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelcidin antibmicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FLJ75188, highly similar to *Homo sapiens* matrillin 2, transcript variant 2, mRNA, SAA, sICAM, sVCAM, CRP, NTproBNP, IFNg, IL-12p70, IL-1b, EMC, and LUM.

Although antibodies are useful because of their extensive characterization, any other suitable agent (e.g., a peptide, an aptamer, or a small organic molecule) that specifically binds a biomarker of the present invention is optionally used in place of the antibody in the above described immunoassays. For example, an aptamer that specifically binds a biomarker and/or one or more of its breakdown products might be used. Aptamers are nucleic acid-based molecules that bind specific ligands. Methods for making aptamers with a particular binding specificity are known as detailed in U.S. Pat. Nos. 5,475,096; 5,670,637; 5,696,249; 5,270,163; 5,707,796; 5,595,877; 5,660,985; 5,567,588; 5,683,867; 5,637,459; and 6,011,020.

In specific embodiments, the assay performed on the biological sample can comprise contacting the biological sample with one or more capture agents (e.g., antibodies, peptides, aptamer, etc., combinations thereof) to form a biomarker:capture agent complex. The complexes can then be detected and/or quantified. A subject can then be identified as having myocardial injury based on a comparison of the detected/quantified/measured levels of biomarkers to one or more reference controls as described herein.

In one method, a first, or capture, binding agent, such as an antibody that specifically binds the biomarker of interest, is immobilized on a suitable solid phase substrate or carrier. The test biological sample is then contacted with the capture antibody and incubated for a desired period of time. After washing to remove unbound material, a second, detection, antibody that binds to a different, non-overlapping, epitope on the biomarker is then used to detect binding of the polypeptide biomarker to the capture antibody. The detection antibody is preferably conjugated, either directly or indirectly, to a detectable moiety. Examples of detectable moieties that can be employed in such methods include, but are not limited to, cheminescent and luminescent agents; fluorophores such as fluorescein, rhodamine and eosin; radioisotopes; colorimetric agents; and enzyme-substrate labels, such as biotin.

In another embodiment, the assay is a competitive binding assay, wherein labeled biomarker is used in place of the labeled detection antibody, and the labeled biomarker and any unlabeled biomarker present in the test sample compete for binding to the capture antibody. The amount of biomarker bound to the capture antibody can be determined based on the proportion of labeled biomarker detected.

Solid phase substrates, or carriers, that can be effectively employed in such assays are well known to those of skill in the art and include, for example, 96 well microtiter plates, glass, paper, and microporous membranes constructed, for example, of nitrocellulose, nylon, polyvinylidene difluoride, polyester, cellulose acetate, mixed cellulose esters and polycarbonate. Suitable microporous membranes include, for example, those described in US Patent Application Publication no. US 2010/0093557 A1. Methods for the automation of immunoassays are well known in the art and include, for example, those described in U.S. Pat. Nos. 5,885,530, 4,981,785, 6,159,750 and 5,358,691.

The presence of several different polypeptide biomarkers in a test sample can be detected simultaneously using a multiplex assay, such as a multiplex ELISA. Multiplex assays offer the advantages of high throughput, a small volume of sample being required, and the ability to detect different proteins across a board dynamic range of concentrations.

In certain embodiments, such methods employ an array, wherein multiple binding agents (for example capture antibodies) specific for multiple biomarkers are immobilized on a substrate, such as a membrane, with each capture agent being positioned at a specific, pre-determined, location on the substrate. Methods for performing assays employing such arrays include those described, for example, in US Patent Application Publication nos. US2010/0093557A and US2010/0190656A1, the disclosures of which are hereby specifically incorporated by reference.

Multiplex arrays in several different formats based on the utilization of, for example, flow cytometry, chemiluminescence or electron-chemiluminesence technology, are well known in the art. Flow cytometric multiplex arrays, also known as bead-based multiplex arrays, include the Cytometric Bead Array (CBA) system from BD Biosciences (Bedford, Mass.) and multi-analyte profiling (xMAP®) technology from Luminex Corp. (Austin, Tex.), both of which employ bead sets which are distinguishable by flow cytometry. Each bead set is coated with a specific capture antibody. Fluorescence or streptavidin-labeled detection antibodies bind to specific capture antibody-biomarker complexes formed on the bead set. Multiple biomarkers can be recognized and measured by differences in the bead sets, with chromogenic or fluorogenic emissions being detected using flow cytometric analysis.

In an alternative format, a multiplex ELISA from Quansys Biosciences (Logan, Utah) coats multiple specific capture antibodies at multiple spots (one antibody at one spot) in the same well on a 96-well microtiter plate. Chemiluminescence technology is then used to detect multiple biomarkers at the corresponding spots on the plate.

B Detection by Mass Spectrometry

Mass spectrometry (MS) can also be used to determine the amount of a protein, using conventional methods. Some typical such methods are described in the Examples herein. Relative ratio between multiple samples can be determined using label free methods (as done in the present Examples), based on spectral count (and the number of unique peptides and the number of observation of each peptide). In particular embodiments, a LTQ-Orbitrap LC/MS/MS instrument can be used. Alternatively, quantitative data can be obtained using multiple reaction monitoring (MRM), most often carried out using a triple quadruple mass spectrometer. In this case, peptides that are unique to a given protein are selected in the MS instrument and quantified. Absolute quantification can be obtained if a known labeled synthetic peptide is used. For detailed methods see, e.g., Qin Fu and JE Van Eyk, in Clinical Proteomics: from diagnostics to therapy (Van Eyk J E and Dunn M, eds), Wiley and Son Press; Current Protocols in Molecular Biology, Preparation of Proteins and Peptides for Mass Spectrometry Analysis in a Bottom-Up Proteomics Workflow, Gundry et al., chapter 10, 2009, in press); and Fu Q, Grote E, Zhu J, Jelinek C, Köttgen A, Coresh J, Van Eyk J E. An Empirical Approach to Signature Peptide Choice for Selected Reaction Monitoring: Quantification of Uromodulin in Urine. Clin Chem. 2016 January; 62(1):198-207. doi: 10.1373/clinchem.2015.242495.

Thus, in one aspect, the biomarkers of the present invention may be detected by mass spectrometry, a method that employs a mass spectrometer to detect gas phase ions. Examples of mass spectrometers are time-of-flight, magnetic sector, quadrupole filter, ion trap, ion cyclotron resonance, Orbitrap, Triple TOFF, hybrids or combinations of the foregoing, and the like.

In particular embodiments, the biomarkers of the present invention are detected using selected reaction monitoring (SRM) mass spectrometry techniques. Selected reaction monitoring (SRM) is a non-scanning mass spectrometry technique, performed on triple quadrupole-like instruments and in which collision-induced dissociation is used as a means to increase selectivity. In SRM experiments two mass analyzers are used as static mass filters, to monitor a particular fragment ion of a selected precursor ion. The specific pair of mass-over-charge (m/z) values associated to the precursor and fragment ions selected is referred to as a "transition" and can be written as parent m/z→fragment m/z (e.g. 673.5→534.3). Unlike common MS based proteomics, no mass spectra are recorded in a SRM analysis. Instead, the detector acts as counting device for the ions matching the selected transition thereby returning an intensity distribution over time. Multiple SRM transitions can be measured within the same experiment on the chromatographic time scale by rapidly toggling between the different precursor/fragment pairs (sometimes called multiple reaction monitoring, MRM). Typically, the triple quadrupole instrument cycles through a series of transitions and records the signal of each transition as a function of the elution time. The method allows for additional selectivity by monitoring the chromatographic coelution of multiple transitions for a given analyte. The terms SRM/MRM are occasionally used also to describe experiments conducted in mass spectrometers other than triple quadrupoles (e.g. in trapping instruments) where upon fragmentation of a specific precursor ion a narrow mass range is scanned in MS2 mode, centered on a fragment ion specific to the precursor of interest or in general in experiments where fragmentation in the collision cell is used as a means to increase selectivity. In this application the terms SRM and MRM or also SRM/MRM can be used interchangeably, since they both refer to the same mass spectrometer operating principle. As a matter of clarity, the term MRM is used throughout the text, but the term includes both SRM and MRM, as well as any analogous technique, such as e.g. highly-selective reaction monitoring, hSRM, LC-SRM or any other SRM/MRM-like or SRM/MRM-mimicking approaches performed on any type of mass spectrometer and/or, in which the peptides are fragmented using any other fragmentation method such as e.g. CAD (collision-activated dissociation (also known as CID or collision-induced dissociation), HCD (higher energy CID), ECD (electron capture dissociation), PD (photodissociation) or ETD (electron transfer dissociation).

In another specific embodiment, the mass spectrometric method comprises matrix assisted laser desorption/ionization time-of-flight (MALDI-TOF MS or MALDI-TOF). In another embodiment, method comprises MALDI-TOF tandem mass spectrometry (MALDI-TOF MS/MS). In yet another embodiment, mass spectrometry can be combined with another appropriate method(s) as may be contemplated by one of ordinary skill in the art. For example, MALDI-TOF can be utilized with trypsin digestion and tandem mass spectrometry as described herein.

In an alternative embodiment, the mass spectrometric technique comprises surface enhanced laser desorption and ionization or "SELDI," as described, for example, in U.S. Pat. Nos. 6,225,047 and 5,719,060. Briefly, SELDI refers to a method of desorption/ionization gas phase ion spectrometry (e.g. mass spectrometry) in which an analyte (here, one or more of the biomarkers) is captured on the surface of a SELDI mass spectrometry probe. There are several versions of SELDI that may be utilized including, but not limited to, Affinity Capture Mass Spectrometry (also called Surface-Enhanced Affinity Capture (SEAC)), and Surface-Enhanced Neat Desorption (SEND) which involves the use of probes comprising energy absorbing molecules that are chemically bound to the probe surface (SEND probe). Another SELDI method is called Surface-Enhanced Photolabile Attachment and Release (SEPAR), which involves the use of probes having moieties attached to the surface that can covalently bind an analyte, and then release the analyte through breaking a photolabile bond in the moiety after exposure to light, e.g., to laser light (see, U.S. Pat. No. 5,719,060). SEPAR and other forms of SELDI are readily adapted to detecting a biomarker or biomarker panel, pursuant to the present invention.

In another mass spectrometry method, the biomarkers can be first captured on a chromatographic resin having chromatographic properties that bind the biomarkers. For example, one could capture the biomarkers on a cation exchange resin, such as CM Ceramic HyperD F resin, wash the resin, elute the biomarkers and detect by MALDI. Alternatively, this method could be preceded by fractionating the sample on an anion exchange resin before application to the cation exchange resin. In another alternative, one could fractionate on an anion exchange resin and detect by MALDI directly. In yet another method, one could capture the biomarkers on an immuno-chromatographic resin that comprises antibodies that bind the biomarkers, wash the resin to remove unbound material, elute the biomarkers from the resin and detect the eluted biomarkers by MALDI or by SELDI.

C. Detection by Polymerase Chain Reaction

In certain embodiments, the biomarkers of the present invention can be detected/measure/quantitated by polymerase chain reaction (PCR). In certain embodiments, the present invention contemplates quantitation of one or more biomarkers described herein including GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelcidin antibmicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FLI75188, highly similar to *Homo sapiens* matrillin 2, transcript variant 2, mRNA, SAA, sICAM, sVCAM, CRP, NTproBNP, IFNg, IL-12p70, IL-1b, EMC, and LUM. The one or more biomarkers can be quantitated and the expression can be compared to reference levels. Overexpression or underexpression, depending on the biomarker, relative to the reference is indicative of injury. PCR can include quantitative type PCR, such as quantitative, real-time PCR (both singleplex and multiplex). In a specific embodiment, the quantitation steps are carried using quantitative, real-time PCR. One of ordinary skill in the art can design primers that specifically bind and amplify one or more biomarkers described herein using the publicly available sequences thereof.

In more particular embodiments, an assay performed on a biological sample obtained from a subject may comprise extracting nucleic acids from the biological sample. The assay can further comprise contacting nucleic acids with one or more primers that specifically bind one or more biomarker described herein to form a primer:biomarker complex. The assay can further comprise the step of amplifying the primer:biomarker complexes. The amplified complexes can then be detected/quantified to determine a level of expression of the one or more biomarkers. A subject can then be identified as having a myocardial injury based on a comparison of the measure/quantified/determined levels of one or more biomarkers described herein to one or more reference controls as described herein. The subject can then be treated appropriately, based on the grade/extent of injury. The assay can be performed on mRNA extracted from the biological sample.

D. Detection by Electrochemicaluminescent Assay

In several embodiments, the biomarker biomarkers of the present invention may be detected by means of an electrochemicaluminescent assay developed by Meso Scale Discovery (Gaithersrburg, Md.). Electrochemiluminescence detection uses labels that emit light when electrochemically stimulated. Background signals are minimal because the stimulation mechanism (electricity) is decoupled from the signal (light). Labels are stable, non-radioactive and offer a choice of convenient coupling chemistries. They emit light at ~620 nm, eliminating problems with color quenching. See U.S. Pat. Nos. 7,497,997; 7,491,540; 7,288,410; 7,036,946; 7,052,861; 6,977,722; 6,919,173; 6,673,533; 6,413,783; 6,362,011; 6,319,670; 6,207,369; 6,140,045; 6,090,545; and 5,866,434. See also U.S. Patent Applications Publication No. 2009/0170121; No. 2009/006339; No. 2009/0065357; No. 2006/0172340; No. 2006/0019319; No. 2005/0142033; No. 2005/0052646; No. 2004/0022677; No. 2003/0124572; No. 2003/0113713; No. 2003/0003460; No. 2002/0137234; No. 2002/0086335; and No. 2001/0021534.

E. Other Methods for Detecting Biomarkers

The biomarkers of the present invention can be detected by other suitable methods. Detection paradigms that can be employed to this end include optical methods, electrochemical methods (voltametry and amperometry techniques), atomic force microscopy, and radio frequency methods, e.g., multipolar resonance spectroscopy. Illustrative of optical methods, in addition to microscopy, both confocal and non-confocal, are detection of fluorescence, luminescence, chemiluminescence, absorbance, reflectance, transmittance, and birefringence or refractive index (e.g., surface plasmon resonance, ellipsometry, a resonant mirror method, a grating coupler waveguide method or interferometry).

Furthermore, a sample may also be analyzed by means of a biochip. Biochips generally comprise solid substrates and have a generally planar surface, to which a capture reagent (also called an adsorbent or affinity reagent) is attached. Frequently, the surface of a biochip comprises a plurality of addressable locations, each of which has the capture reagent bound there. Protein biochips are biochips adapted for the capture of polypeptides. Many protein biochips are described in the art. These include, for example, protein biochips produced by Ciphergen Biosystems, Inc. (Fremont, Calif.), Invitrogen Corp. (Carlsbad, Calif.), Affymetrix, Inc. (Fremong, Calif.), Zyomyx (Hayward, Calif.), R&D Systems, Inc. (Minneapolis, Minn.), Biacore (Uppsala, Sweden) and Procognia (Berkshire, UK). Examples of such protein biochips are described in the following patents or published patent applications: U.S. Pat. Nos. 6,537,749; 6,329,209; 6,225,047; 5,242,828; PCT International Publication No. WO 00/56934; and PCT International Publication No. WO 03/048768.

III. Determination of a Patient's Myocardial Injury Status

A detection (diagnostic) method of the invention can be adapted for many uses. For example, it can be used to follow the progression of cardiac ischemia. In one embodiment of the invention, the detection is carried out both before (or at approximately the same time as), and after, the administration of a treatment, and the method is used to monitor the effectiveness of the treatment. A subject can be monitored in this way to determine the effectiveness for that subject of a particular drug regimen, or a drug or other treatment modality can be evaluated in a pre-clinical or clinical trial. If a treatment method is successful, the levels of the protein markers of the invention are expected to decrease.

A method of the invention can be used to suggest a suitable method of treatment for a subject. For example, if a subject is determined by a method of the invention to be likely to have myocardial ischemia, a decision can be made to treat the subject with an aggressive form of treatment; and, in one embodiment, the treatment is then administered. Suitable aggressive treatment modalities include, for example, angioplasty (mechanical widening to open blood vessels); treating with an anti-thrombolysis agent or, if possible, with percutaneous coronary intervention (PCI, or TPA); or undergoing coronary bypass surgery to replace the injured/blocked coronary artery. By contrast, if a subject is determined not to be likely to have myocardial ischemia, a decision can be made to adopt a less aggressive treatment regimen; and, in one embodiment, the subject is then treated with this less aggressive forms of treatment. Suitable less aggressive forms of treatment include, for example, treatment with asprin and/or agents that bring about thrombolysis (e.g., TPA); periodic monitoring to ensure no future MI events; or recommending changes in life style. A subject that does not have myocardial ischemia is thus spared the unpleasant side-effects associated with the unnecessary, more aggressive forms of treatment. By "treated" is meant that an effective amount of a drug or other anti-heart disease procedure is administered to the subject. An "effective" amount of an agent refers to an amount that elicits a detectable response (e.g., of a therapeutic response) in the subject.

The present invention relates to the use of biomarkers to diagnose myocardial injury. More specifically, the biomarkers of the present invention can be used in diagnostic tests to determine, qualify, and/or assess myocardial injury or status, for example, to diagnose myocardial injury, in an individual, subject or patient. In particular embodiments, myocardial injury status can include determining a patient's myocardial injury status or myocardial injury status, for example, to diagnose myocardial injury, in an individual, subject or patient. More specifically, the biomarkers to be detected in diagnosing myocardial injury include, but are not limited to, GM-CSF, IL-10, IL-2, IL-6, IL-8, TNFa, TnI, S100A9, PRD2, LTF, Exostosin-like 2, cDNAFLIS3119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelcidin antimicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FL175188, highly similar to *Homo sapiens* matrillin 2, transcript variant 2, mRNA, SAA, sICAM, sVCAM, CRP, NTproBNP, IFNg, IL-12p70, IL-1b, EMC, and LUM. Other biomarkers known in the relevant art may be used in combination with the biomarkers described herein. The present invention further contemplates the detection, measurement, quantification, determination and the like of both unmodified and modified (e.g., glycosylation or other post-translational modification) proteins/polypeptides/peptides as well as autoantibodies to any of the foregoing, determining a patient's myocardial injury status. It is understood that the methods and compositions described herein can not only be used to diagnose myocardial injury.

A. Biomarker Panels

The biomarkers of the present invention can be used in diagnostic tests to assess, determine, and/or qualify (used interchangeably herein) myocardial injury status in a patient. The phrase "myocardial injury status" includes any distinguishable manifestation of the condition, including not having myocardial injury. For example, myocardial injury status includes, without limitation, the presence or absence of myocardial injury in a patient, the risk of developing myocardial injury, the stage or severity of myocardial injury, the progress of myocardial injury (e.g., progress of myocardial injury over time), the effectiveness or response to treatment of myocardial injury (e.g., clinical follow up and surveillance of myocardial injury after treatment). Based on this status, further procedures may be indicated, including additional diagnostic tests or therapeutic procedures or regimens.

In particular embodiments, the biomarkers comprise one or more of GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelcidin antimicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FL175188, highly similar to *Homo sapiens* matrillin 2, transcript variant 2, mRNA, SAA1, sICAM, sVCAM, CRP, NTproBNP, IFNg, IL-12p70, IL-1b, ECM1, and LUM.

In certain embodiments, the biomarkers comprise one or more of APOA2, BLMH, CA1, CAMP, CASP14, CAT, CD38, CDSL, CFP, CHGA, CNDP1, CSRP1, CSTA, CTSL, DBH, DSG1, DSP, ECM1, EXTL2, Fam136A, GAPDH, H2AFZ, HIST1H1B, HIST1H1E, HIST1H4A, HLA-A, ICAM1, IGFB1, IGHG2, IL2, LCN2, LTF, LUM, MATN2, MB, MMP9, MPO, MYH6, MYH7, NPPB, PFN1, PRDX2, S100A12, S100A4, S100A6, S100A7, S100A9, SAA1, SEMG1, TAGLN2, TGM3, TNNI3, VASP, and VCAM1.

The biomarkers can comprise one or more of carbonic anhydrase 1 (CA), cysteine and glycine-rich protein 1 (CAT1), properdin (CFP), desmoplakin (DSP), extracellular matrix protein 1 (EMC1), lactoferrin (LTF), lumican (LUM), myosin-7 (MYH7), peroxiredoxin-2 (PRDX2), S100A7, S100A9, SAA1, and semenogelin-1 (SEMG1).

In particular embodiments, the biomarkers comprise one or more of Exostosin-like 2 (EXTL2), cDNA FU53119, highly similar to ADP-ribosyl cyclase 1 (EC 3.2.2.5) (CD38), Protein S100-A12 (S100A12), Cysteine and glycine-rich protein 1 (CSRP1), Isoform 2 of Transmembrane protease serine 4 (TMPRSS4), Transgelin-2 (TAGLN2), Profilin-1 (PFN1), Matrix metalloproteinase-9 (MMP9), Protein S100-A4 (S100A4), Histone H1.5 (HIST1H1B), Properdin (CFP), Vasodilator-simulated phosphoprotein (VASP), Myosin-7 (MYH7), Myosin-6 (MYH6), MHC class I antigen (Fragment) (HLA-A), CD5 antigen-like (CDSL), Cystatin-A (CSTA), Cathepsin L1 (CTSL1), Dopamine beta-hydroxylase (DBH), Histone H2A.Z(H2AFZ), Prolactin-inducible protein (PIP), Isoform VCAM-6D of Vascular cell adhesion protein1 (VCAM1), Caspase-14 (CASP14), Regulator of G-protein signaling 19 (RSG19), Cathelicidin antimicrobial peptide (CAMP includes EG:12796), Desmoglein-1 (DSG1)1, Protein-glutamine gamma-glutamyltransferase E (TGM3), Bleomycin hydrolase (BLMH), Protein FAM136A (FAM136A), Isoform H14 of Myeloperoxidase (MPO), Isoform 2 of Neutrophil gelatinase-associated lipocalin (LCN2), Beta-Ala-His dipeptidase (CNDP1), Catalase (CAT), Desmoplakin (DSP), Glyceraldehyde-3-phosphate dehydrogenase (GAPDH), Ig gamma-2 chain C region (IGHG2), Myoglobin (MB), Protein S100-A9 (S100A9), Semenogelin-1 (SEMG1), Chromogranin-A (CHGA), Histone H4 (HIST1H4A includes others), Histone H1.4 (HIST1H1E), Protein S100-A7 (S100A7), Apolipoprotein A-II (APOA2), Carbonic anhydrase 1 (CA1), Lactoferrin (LTF), Insulin-like growth factor-binding protein 1 (IGFBP1 includes EG: 16006), cDNA FLJ75188, highly similar to *Homo sapiens* matrillin 2, transcript variant 2, mRNA (MATN2), Peroxiredoxin-2 (PRDX2) and Extracellular matrix protein 1 (ECM1).

The biomarkers can comprise one or more Class I markers shown in Tables 8-10. Such markers include one or more of EXTL2, CD38, S100A12, CSRP1, TMPRSS4, TAGLN2, PFN1, MMP9, S100A4, HIST1H1B, CFP, VASP, MH7, MH6, HLA-A, CD5L, CSTA, CTSL1, DBH, H2AFZ, PIP, VCAM1, CASP14, RGS19, CAMP, DSG1, TGM3, BLMH, FAM136A. The biomarkers can comprise one or more Class II markers shown in Table 10. Such markers include one or more of S100A6, MPO, LCN2, CNDP1, CAT, DSP, GAPDH, IGHG2, MB, S100A9, SEMG1, CHGA, HIST1H4A, HIST1HE, S100A7, APOA2, CA1, LTF, IGFBP1, MATN2 and PRDX2. In alternative embodiments, the biomarkers can comprise one or more Class I markers and one or more Class II markers.

In particular embodiments, the biomarkers can comprise one or more listed in Tables 11-12, specifically, one or more of LTF, S100A9, PRD (also known as PRD-2 or PRDX2), S100A9, and S100A8. Alternatively, the biomarkers can comprise one or more of CA1, CAT, CFP, DSP, ECM1, LTF, LUM, MYH7, PRDX2, S100A7, S100A9, SAA1 and SEMG1 (see Table 5).

In certain embodiments, the biomarkers comprise one or more of ANG, ECM1, LPLUNC1, LTF, LUM, S100A9, PRDX2 and SEMG1. In other embodiments, the biomarkers comprise one or more of APOA2, CA1, CD38, CAT, MMP9, LCN2 (also known as NGAL2), S100A7, and S100A8. The biomarkers can also comprise one or more of CNDP1, CSRP1, EXTL2, S100A1, S100A12, S100A4, S100A6, SH3, THIO, TMPR4 (also known as TMPRSS4). In other embodiments, the biomarkers comprise one or more of the biomarkers described in Example 2-4.

It is understood that the term biomarkers means the protein itself in general, as well as peptides of the biomarker protein. In other words, a biomarker refers to a level of the full length protein. It also refers to the levels of one or more peptides of the protein itself. In certain embodiments, the term biomarkers refers to measuring a level of the full length protein, isoforms thereof, as well as peptides of the foregoing. Such proteins, isoforms and peptides of the foregoing include post-translational modified forms. The PTMs can include citrullination (Cit), oxidation (Oxi), phosphorylation (Phospho), glycosylation, etc. Thus, within the scope of the embodiments listed above and herein, are peptides of the foreoing including PTMs. For example, in certain embodiments, CA biomarkers include citrullinated forms as well including, but not limited to, citrullinated peptides such as SEQ ID NOS:1-2. CAT biomarkers also include citrullinated and oxidized forms such as SEQ ID NOS:3-4. See Tables 5 and 6 for additional embodiments. It is understood the embodiments of the present invention include peptides of the proteins described herein including PTMs shown in Tables 5 and 6.

References to biomarkers (full length, isoforms, peptides (including peptides comprising one or more PTMs) can be described in conjunction with the full length (or isoform length) of the biomarker protein. Accession Numbers described herein refer to the accession number useful for searching in databases such as Uniprot. For example, the following biomarkers and associated accession numbers for sequence include Exostosin-like 2 (EXTL2): Q9UBQ6 (SEQ ID NO:1107), B4DNZ2 (SEQ ID NO:1108), C9IYF5 (SEQ ID NO:1109), C9JEG3 (SEQ ID NO:1110), D3DT60 (SEQ ID NO:111), Q05DH5 (SEQ ID NO:1112), Q49A43 (SEQ ID NO:1113), Q8IYF4 (SEQ ID NO:1114), Q8N8F1 (SEQ ID NO:1115); cDNA FLJ53119, highly similar to ADP-ribosyl cyclase 1 (EC 3.2.2.5) (CD38): B4E006 (SEQ ID NO:1116); Protein S100-A12 (S100A12): P80511 (SEQ ID NO:1117); Cysteine and glycine-rich protein 1 (CSRP1):, P21291 (SEQ ID NO:1118), A8K268 (SEQ ID NO:1119), B4DY28 (SEQ ID NO:1120), B4E2T4 (SEQ ID NO:1121), Q59EQ5 (SEQ ID NO:1122), QSUJ2 (SEQ ID NO:1123), Q6ZMS3 (SEQ ID NO:1124), Q9BTA4 (SEQ ID NO:1125); Isoform 2 of Transmembrane protease serine 4 (TMPRSS4): Q9NRS4-2 (SEQ ID NO:1126), Q9NRS4-3 (SEQ ID NO:1127), Q9NRS4 (SEQ ID NO:1128), A8K2U6 (SEQ ID NO:1129), B7Z8X1 (SEQ ID NO:1130), B7Z900 (SEQ ID NO:1131); Transgelin-2 (TAGLN2): P37802 (SEQ ID NO:1132); Profilin-1 (PFN1): P07737 (SEQ ID NO:1133), Q53Y44 (SEQ ID NO:1134); Matrix metalloproteinase-9 (MMP9): P14780 (SEQ ID NO:1135), B7Z747 (SEQ ID NO:1136); Protein S100-A4 (S100A4): P26447 (SEQ ID NO:1137), D3DV46 (SEQ ID NO:1138); Histone H1.5 (HIST1H1B): P16401 (SEQ ID NO:1139); Properdin (CFP): P27918 (SEQ ID NO:1140); Vasodilator-simulated phosphoprotein (VASP): P50552 (SEQ ID NO:1141); Myosin-7 (MYH7): P12883 (SEQ ID NO:1142); Myosin-6 (MYH6): P13533 (SEQ ID NO:1143), D9YZU2 (SEQ ID NO:1144); MHC class I antigen (Fragment) (HLA-A): D7NNN8 (SEQ ID NO:1145), D7NNP3 (SEQ ID NO:1146), Q05G04 (SEQ ID NO:1147); CD5 antigen-like (CD5L): 043866 (SEQ ID NO:1148); Cystatin-A (CSTA): P01040 (SEQ ID NO:1149), C9J0E4 (SEQ ID NO:1150), Q6IB90 (SEQ ID NO:1151); Cathepsin L1 (CTSL1): P07711 (SEQ ID NO:1152), ASPLM9 (SEQ ID NO:1153), B3KQK4 (SEQ ID NO:1154), Q5T8F0 (SEQ ID NO:1155); Dopamine beta-hydroxylase (DBH): P09172 (SEQ ID NO:1156); Histone H2A.Z(H2AFZ): POCOSS (SEQ ID NO:1157), Q71UI9 (SEQ ID NO:1158), A6NN01 (SEQ ID NO:1159), C9J0D1 (SEQ ID NO:1160); Prolactin-inducible protein (PIP): P12273 (SEQ ID NO:1161); Isoform VCAM-6D of Vascular cell adhesion protein1 (VCAM1): P19320-2 (SEQ ID NO:1162), P19320 (SEQ ID NO:1163), B4DKS4 (SEQ ID NO:1164), Q53FL7 (SEQ ID NO:1165); Caspase-14 (CASP14): P31944 (SEQ ID NO:1166), B2CIS9 (SEQ ID NO:1167); Regulator of G-protein signaling 19 (RSG19): P49795 (SEQ ID NO:1168), B4DP94 (SEQ ID NO:1169), Q619S5 (SEQ ID NO: 1170); Cathelicidin antimicrobial peptide (CAMP includes EG:12796): P49913 (SEQ ID NO:1171); Desmoglein-1 (DSG1)1: Q02413 (SEQ ID NO: 1172); Protein-glutamine gamma-glutamyltransferase E (TGM3): Q08188 (SEQ ID NO: 1173), B4DQ50 (SEQ ID NO: 1174), D3DVX1 (SEQ ID NO: 1175); Bleomycin hydrolase (BLMH): Q13867 (SEQ ID NO:1176); Protein FAM136A (FAM136A): Q96C01 (SEQ ID NO:1177), BOAZT6 (SEQ ID NO:1178), C9JF51 (SEQ ID NO:1179); Protein S100-A6 (S100A6): P06703 (SEQ ID NO:1180), D3DV39 (SEQ ID NO:1181); Isoform H14 of Myeloperoxidase (MPO): P05164-2 (SEQ ID NO: 1182), P05164-3 (SEQ ID NO: 1183), P05164 (SEQ ID NO:1184); Isoform 2 of Neutrophil gelatinase-associated lipocalin (LCN2): P80188-2 (SEQ ID NO:1185), P80188 (SEQ ID NO:1186), B2ZDQ1 (SEQ ID NO:1187); Beta-Ala-His dipeptidase (CNDP1): Q96KN2 (SEQ ID NO:1188), A8K1K1 (SEQ ID NO:1189), B4E180 (SEQ ID NO:1190); Catalase (CAT): P04040 (SEQ ID NO:1191), D3DR07 (SEQ ID NO:1192); Desmoplakin (DSP): P15924 (SEQ ID NO:1193); Glyceraldehyde-3-phosphate dehydrogenase (GAPDH): P04406 (SEQ ID NO:1194), Q2TSD0 (SEQ ID NO:1195); Ig gamma-2 chain C region (IGHG2): P01859 (SEQ ID NO:1196); Myoglobin (MB): P02144 (SEQ ID NO:1197), B2RA67 (SEQ ID NO:1198), Protein S100-A9 (S100A9):, P06702 (SEQ ID NO:1199), D3DV36 (SEQ ID NO:1200); Semenogelin-1 (SEMG1): P04279 (SEQ ID NO:1201), Chromogranin-A (CHGA): P10645 (SEQ ID NO:1202); Histone H4 (HIST1H4A includes others): P62805 (SEQ ID NO:1203), B2R4R0 (SEQ ID NO:1204), Q0VAS5 (SEQ ID NO:1205); Histone H1.4 (HIST1H1E): P10412 (SEQ ID NO:1206), P16402 (SEQ ID NO:1207), P16403 (SEQ ID NO:1208), A3R0T7 (SEQ ID NO:1209), A3R0T8 (SEQ ID NO:1210), A8K4I2 SEQ ID NO:1211), B2R984 (SEQ ID NO:1212), Q4VB24 (SEQ ID NO:1213); Protein S100-A7 (S100A7): P31151 (SEQ ID NO:1214); Apolipoprotein A-II (APOA2): P02652 (SEQ ID NO:1215); Carbonic anhydrase 1 (CA1): P00915 (SEQ ID NO:1216); Lactoferrin (LTF): Q2TUW9 (SEQ ID NO:1217); Insulin-like growth factor-binding protein 1 (IGFBP1 includes EG: 16006):, P08833 (SEQ ID NO:1218), CIK3N3 (SEQ ID NO:1219), C9JXF9 (SEQ ID NO:1220), D3DVL9 (SEQ ID NO:1221), Q6PEY6 (SEQ ID NO:1222); cDNA FLJ75188, highly similar to *Homo sapiens* matrillin 2, transcript variant 2, mRNA (MATN2): A8K106 (SEQ ID NO:1223); Peroxiredoxin-2 (PRDX2): P32119 (SEQ ID NO:1224), B4DF70 (SEQ ID NO:1225); Extracellular matrix protein 1 (ECM1): Q16610 (SEQ ID NO:1226); Intracellular adhesion molecule 1 (ICAM1): P05362 (SEQ ID NO:1227); Interleukin-2 (IL2): P60568 (SEQ ID NO:1228); Lumican (LUM): P51884 (SEQ ID NO:1229); Natriuretic Peptide B (NPPB): P16860 (SEQ ID NO:1230); Serum amyloid A-1 protein (SAA1): P0DJI8 (SEQ ID NO:1231). A skilled artisan can associate a PTM peptide (e.g., in Tables 5 and 6) with a full length (or isoform length) of the biomarker protein described in SEQ ID NOS:1107-1235).

The power of a diagnostic test to correctly predict status is commonly measured as the sensitivity of the assay, the specificity of the assay or the area under a receiver operated characteristic ("ROC") curve. Sensitivity is the percentage of true positives that are predicted by a test to be positive, while specificity is the percentage of true negatives that are predicted by a test to be negative. An ROC curve provides the sensitivity of a test as a function of 1-specificity. The greater the area under the ROC curve, the more powerful the predictive value of the test. Other useful measures of the utility of a test are positive predictive value and negative predictive value. Positive predictive value is the percentage of people who test positive that are actually positive. Negative predictive value is the percentage of people who test negative that are actually negative.

In particular embodiments, the biomarker panels of the present invention may show a statistical difference in different myocardial injury statuses of at least $p<0.05$, $p<10^{-2}$, $p<10^{-3}$, $p<10^{-4}$ or $p<10^{-5}$. Diagnostic tests that use these biomarkers may show an ROC of at least 0.6, at least about 0.7, at least about 0.8, or at least about 0.9.

The biomarkers can be differentially present in UI (NC or non-myocardial injury) and myocardial injury, and, therefore, are useful in aiding in the determination of myocardial injury status. In certain embodiments, the biomarkers are measured in a patient sample using the methods described herein and compared, for example, to predefined biomarker levels/ratios and correlated to myocardial injury status. In particular embodiments, the measurement(s) may then be compared with a relevant diagnostic amount(s), cut-off(s), or multivariate model scores that distinguish a positive myocardial injury status from a negative myocardial injury status. The diagnostic amount(s) represents a measured amount of a biomarker(s) above which or below which a patient is classified as having a particular myocardial injury status. For example, if the biomarker(s) is/are up-regulated compared to normal during myocardial injury, then a measured amount(s) above the diagnostic cutoff(s) provides a diagnosis of myocardial injury. Alternatively, if the biomarker(s) is/are down-regulated during myocardial injury, then a measured amount(s) at or below the diagnostic cutoff(s) provides a diagnosis of non-myocardial injury. As is well understood in the art, by adjusting the particular diagnostic cut-off(s) used in an assay, one can increase sensitivity or specificity of the diagnostic assay depending on the preference of the diagnostician. In particular embodiments, the particular diagnostic cut-off can be determined, for example, by measuring the amount of biomarkers in a statistically significant number of samples from patients with the different myocardial injury statuses, and drawing the cut-off to suit the desired levels of specificity and sensitivity.

In other embodiments, ratios of post-translationally modified biomarkers to the corresponding unmodified biomarkers are useful in aiding in the determination of myocardial injury status. In certain embodiments, the biomarker ratios are indicative of diagnosis. In other embodiments, a biomarker ratio can be compared to another biomarker ratio in the same sample or to a set of biomarker ratios from a control or reference sample.

Indeed, as the skilled artisan will appreciate there are many ways to use the measurements of two or more biomarkers in order to improve the diagnostic question under investigation. In a quite simple, but nonetheless often effective approach, a positive result is assumed if a sample is positive for at least one of the markers investigated.

Furthermore, in certain embodiments, the values measured for markers of a biomarker panel are mathematically combined and the combined value is correlated to the underlying diagnostic question. Biomarker values may be combined by any appropriate state of the art mathematical method. Well-known mathematical methods for correlating a marker combination to a disease status employ methods like discriminant analysis (DA) (e.g., linear-, quadratic-, regularized-DA), Discriminant Functional Analysis (DFA), Kernel Methods (e.g., SVM), Multidimensional Scaling (MDS), Nonparametric Methods (e.g., k-Nearest-Neighbor Classifiers), PLS (Partial Least Squares), Tree-Based Methods (e.g., Logic Regression, CART, Random Forest Methods, Boosting/Bagging Methods), Generalized Linear Models (e.g., Logistic Regression), Principal Components based Methods (e.g., SIMCA), Generalized Additive Models, Fuzzy Logic based Methods, Neural Networks and Genetic Algorithms based Methods. The skilled artisan will have no problem in selecting an appropriate method to evaluate a biomarker combination of the present invention. In one embodiment, the method used in a correlating a biomarker combination of the present invention, e.g. to diagnose myocardial injury, is selected from DA (e.g., Linear-, Quadratic-, Regularized Discriminant Analysis), DFA, Kernel Methods (e.g., SVM), MDS, Nonparametric Methods (e.g., k-Nearest-Neighbor Classifiers), PLS (Partial Least Squares), Tree-Based Methods (e.g., Logic Regression, CART, Random Forest Methods, Boosting Methods), or Generalized Linear Models (e.g., Logistic Regression), and Principal Components Analysis. Details relating to these statistical methods are found in the following references: Ruczinski et al., 12 J. OF COMPUTATIONAL AND GRAPHICAL STATISTICS 475-511 (2003); Friedman, J. H., 84 J. OF THE AMERICAN STATISTICAL ASSOCIATION 165-75 (1989); Hastie, Trevor, Tibshirani, Robert, Friedman, Jerome, The Elements of Statistical Learning, Springer Series in Statistics (2001); Breiman, L., Friedman, J. H., Olshen, R. A., Stone, C. J. Classification and regression trees, California: Wadsworth (1984); Breiman, L., 45 MACHINE LEARNING 5-32 (2001); Pepe, M. S., The Statistical Evaluation of Medical Tests for Classification and Prediction, Oxford Statistical Science Series, 28 (2003); and Duda, R. O., Hart, P. E., Stork, D. G., Pattern Classification, Wiley Interscience, 2nd Edition (2001).

C. Determining Risk of Developing Myocardial Injury

In a specific embodiment, the present invention provides methods for determining the risk of developing myocardial injury in a patient. Biomarker percentages, ratios, amounts or patterns are characteristic of various risk states, e.g., high, medium or low. The risk of developing myocardial injury is determined by measuring the relevant biomarkers and then either submitting them to a classification algorithm or comparing them with a reference amount, i.e., a predefined level or pattern of biomarkers that is associated with the particular risk level.

D. Determining Myocardial Injury Severity

In another embodiment, the present invention provides methods for determining the severity of myocardial injury in a patient. Each grade or stage of myocardial injury likely has a characteristic level of a biomarker or relative levels/ratios of a set of biomarkers (a pattern or ratio). The severity of myocardial injury is determined by measuring the relevant biomarkers and then either submitting them to a classification algorithm or comparing them with a reference amount, i.e., a predefined level or pattern of biomarkers that is associated with the particular stage.

E. Determining Myocardial Injury Prognosis

In one embodiment, the present invention provides methods for determining the course of myocardial injury in a patient. Myocardial injury course refers to changes in myocardial injury status over time, including myocardial injury progression (worsening) and myocardial injury regression (improvement). Over time, the amount or relative amount (e.g., the pattern or ratio) of the biomarkers changes. For example, biomarker "X" may be increased with myocardial injury, while biomarker "Y" may be decreased with myocardial injury. Therefore, the trend of these biomarkers, either increased or decreased over time toward myocardial injury or non-myocardial injury indicates the course of the condition. Accordingly, this method involves measuring the level of one or more biomarkers in a patient at least two different time points, e.g., a first time and a second time, and comparing the change, if any. The course of myocardial injury is determined based on these comparisons.

F. Patient Management

In certain embodiments of the methods of qualifying myocardial injury status, the methods further comprise managing patient treatment based on the status. Such management includes the actions of the physician or clinician subsequent to determining myocardial injury status. For example, if a physician makes a diagnosis of myocardial injury, then a certain regime of monitoring would follow. An assessment of the course of myocardial injury using the methods of the present invention may then require a certain myocardial injury therapy regimen. Alternatively, a diagnosis of non-myocardial injury might be followed with further testing to determine a specific disease that the patient might be suffering from. Also, further tests may be called for if the diagnostic test gives an inconclusive result on myocardial injury status.

G. Determining Therapeutic Efficacy of Pharmaceutical Drug

In another embodiment, the present invention provides methods for determining the therapeutic efficacy of a pharmaceutical drug. These methods are useful in performing clinical trials of the drug, as well as monitoring the progress of a patient on the drug. Therapy or clinical trials involve administering the drug in a particular regimen. The regimen may involve a single dose of the drug or multiple doses of the drug over time. The doctor or clinical researcher monitors the effect of the drug on the patient or subject over the course of administration. If the drug has a pharmacological impact on the condition, the amounts or relative amounts (e.g., the pattern, profile or ratio) of one or more of the biomarkers of the present invention may change toward a non-myocardial injury profile. Therefore, one can follow the course of one or more biomarkers in the patient during the course of treatment. Accordingly, this method involves measuring one or more biomarkers in a patient receiving drug therapy, and correlating the biomarker levels/ratios with the myocardial injury status of the patient (e.g., by comparison to predefined levels/ratios of the biomarkers that correspond to different myocardial injury statuses). One embodiment of this method involves determining the levels/ratios of one or more biomarkers for at least two different time points during a course of drug therapy, e.g., a first time and a second time, and comparing the change in levels/ratios of the biomarkers, if any. For example, the levels/ratios of one or more biomarkers can be measured before and after drug administration or at two different time points during drug administration. The effect of therapy is determined based on these comparisons. If a treatment is effective, then the level/ratio of one or more biomarkers will trend toward normal, while if treatment is ineffective, the level/ratio of one or more biomarkers will trend toward myocardial injury indications.

In another embodiment of the invention, the methods of the present invention are used as a screen in order to identify a drug (or to improve a cardioplegic solution) that protects the heart from ischemia and necrosis. The detection of one or more of the proteins of the invention in blood (or media if cell culture is used) is indicative of ischemia, and the quantity of the protein(s) is indicative of the severity of the ischemia.

H. Generation of Classification Algorithms for Qualifying Myocardial Injury Status In some embodiments, data that are generated using samples such as "known samples" can then be used to "train" a classification model. A "known sample" is a sample that has been pre-classified. The data that are used to form the classification model can be referred to as a "training data set." The training data set that is used to form the classification model may comprise raw data or pre-processed data. Once trained, the classification model can recognize patterns in data generated using unknown samples. The classification model can then be used to classify the unknown samples into classes. This can be useful, for example, in predicting whether or not a particular biological sample is associated with a certain biological condition (e.g., diseased versus non-diseased).

Classification models can be formed using any suitable statistical classification or learning method that attempts to segregate bodies of data into classes based on objective parameters present in the data. Classification methods may be either supervised or unsupervised. Examples of supervised and unsupervised classification processes are described in Jain, "Statistical Pattern Recognition: A Review", IEEE Transactions on Pattern Analysis and Machine Intelligence, Vol. 22, No. 1, January 2000, the teachings of which are incorporated by reference.

In supervised classification, training data containing examples of known categories are presented to a learning mechanism, which learns one or more sets of relationships that define each of the known classes. New data may then be applied to the learning mechanism, which then classifies the new data using the learned relationships. Examples of supervised classification processes include linear regression processes (e.g., multiple linear regression (MLR), partial least squares (PLS) regression and principal components regression (PCR)), binary decision trees (e.g., recursive partitioning processes such as CART), artificial neural networks such as back propagation networks, discriminant analyses (e.g., Bayesian classifier or Fischer analysis), logistic classifiers, and support vector classifiers (support vector machines).

Another supervised classification method is a recursive partitioning process. Recursive partitioning processes use recursive partitioning trees to classify data derived from unknown samples. Further details about recursive partitioning processes are provided in U.S. Patent Application No. 2002 0138208 A1 to Paulse et al., "Method for analyzing mass spectra."

In other embodiments, the classification models that are created can be formed using unsupervised learning methods. Unsupervised classification attempts to learn classifications based on similarities in the training data set, without pre-classifying the spectra from which the training data set was derived. Unsupervised learning methods include cluster analyses. A cluster analysis attempts to divide the data into "clusters" or groups that ideally should have members that are very similar to each other, and very dissimilar to members of other clusters. Similarity is then measured using some distance metric, which measures the distance between data items, and clusters together data items that are closer to each other. Clustering techniques include the MacQueen's K-means algorithm and the Kohonen's Self-Organizing Map algorithm.

Learning algorithms asserted for use in classifying biological information are described, for example, in PCT International Publication No. WO 01/31580 (Barnhill et al., "Methods and devices for identifying patterns in biological systems and methods of use thereof"), U.S. Patent Application Publication No. 2002/0193950 (Gavin et al. "Method or analyzing mass spectra"), U.S. Patent Application Publication No. 2003/0004402 (Hitt et al., "Process for discriminating between biological states based on hidden patterns from biological data"), and U.S. Patent Application Publication No. 2003/0055615 (Zhang and Zhang, "Systems and methods for processing biological expression data").

The classification models can be formed on and used on any suitable digital computer. Suitable digital computers include micro, mini, or large computers using any standard or specialized operating system, such as a Unix, Windows® or Linux™ based operating system. In embodiments utilizing a mass spectrometer, the digital computer that is used may be physically separate from the mass spectrometer that is used to create the spectra of interest, or it may be coupled to the mass spectrometer.

The training data set and the classification models according to embodiments of the invention can be embodied by computer code that is executed or used by a digital computer. The computer code can be stored on any suitable computer readable media including optical or magnetic disks, sticks, tapes, etc., and can be written in any suitable computer programming language including R, C, C++, visual basic, etc.

The learning algorithms described above are useful both for developing classification algorithms for the biomarkers already discovered, and for finding new biomarker biomarkers. The classification algorithms, in turn, form the base for diagnostic tests by providing diagnostic values (e.g., cut-off points) for biomarkers used singly or in combination.

IV. Kits for the Detection of Myocardial Injury Biomarkers

In another aspect, the present invention provides kits for qualifying myocardial injury status, which kits are used to detect the biomarkers described herein. In a specific embodiment, the kit is provided as an ELISA kit comprising antibodies to one or more of the biomarkers of the present invention including, but not limited to, GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Proalctin-inducible protein, Isoform VCAM-6D of Vascular cell adhesion protein 1, Caspase-14, Regulator of G-protein signaling 19, Cathelicidin antibmicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, 4953-665-4437.2 Page 46 of 255 065472-X0064M Histone H4, Histone H1.4, Protein S100-A7, Apolipoprotein A-II, Carbonic anhydrase 1, Insulin-like growth factor-binding protein 1, cDNA FL175188, highly similar to *Homo sapiens* matrillin 2, transcript variant 2, mRNA, SAA, sICAM, sVCAM, CRP, NTproBNP, IFNg, IL-12p70, IL-1b, EMC, and LUM.

A kit can also comprise antibodies that specifically bind a biomarker comprising a PTM, as opposed to a biomarker protein not having the PTM. In certain embodiments, different antibodies can be used to the same biomarker protein, each antibody recognizing a specific PTM of the biomarker. The PTMS include, for example, citrullination, phosphorylation and oxidation. Post translational modification of carbonic anhydrase 1 (CA1) can include citrullination (ESISVSSEQLAQFR[157] (SEQ ID NO:1), SLLSNVEGDNAVPMQHNNR[157]PTQPLK (SEQ ID NO:2)). PTM of CAT includes citrullination (NAIHTFVQSGSHLAAR[157] (SEQ ID NO:3)) and oxidation (M) (HM[147]N[115]GYGSHTFK (SEQ ID NO:4)). PTM of properdin (CFP) can include oxi (M) (YPPTVSM[147]VEGQGEK (SEQ ID NO:5)). PTM of desmoplakin (DSP) can include citrullination (IGLVR[157]PGTALEL-LEAQAATGFIVDPVSNLR (SEQ ID NO:6)). PTM of extracellular matrix protein 1 (ECM1) can include citrullination (DILTIDIGR[157] (SEQ ID NO:7), LVWEEAMSR[157] (SEQ ID NO:8), NLPATDPLQR[157] (SEQ ID NO:9), QGETLNFLEIGYSR[157] (SEQ ID NO:10), QHV-VYGPWNLPQSSYSHLTR[157] (SEQ ID NO:11)) and citrullination and phosphorylation (Q[129]HVVYGPWN[115]LPQ[129]S[167]S[167]Y[243]S[167]HLT[181]R[157] (SEQ ID NO:12)). PTM of lactoferrin (LTF) can include citrullination (IDSGLYLGSGYFTAIQNLR[157] (SEQ ID NO:13)), VPSHAVVAR[157] (SEQ ID NO:14)) and phosphorylation (S[167]DT[181]S[167]LT[181]W[202]N[115]S[1167]VK (SEQ ID NO:15)). PTM of Lumican (LUM) can include citrullination (FN[115]ALQ[129]YLR[157] (SEQ ID NO:16), FNALQYLR[157] (SEQ ID NO:17), SLEYLD-LSFNQIAR[157] (SEQ ID NO:18)). PTM of Myosin-7 (MYH7) can include oxidation (M) (IEDMAM[147]LTFL-HEPAVLYNLK(SEQ ID NO:19)). Peroxiredoxin-2 (PRD2) PTMs include citrullination (EGGLGPLNIPLLADVTR[157] (SEQ ID NO:20), R[157]LSEDYGVLK(SEQ ID NO:21), TDEGIAYR[157] (SEQ ID NO:22)). S100A7: Oxidation(M) (SIIGM[147]IDM[147]FHK (SEQ ID NO:23), SIIGMIDM[147]FHK) (SEQ ID NO:24); Phosphoratio (Q[112]S[167]HGAAPCS[167]GGS[167]Q[129] (SEQ ID NO:25)). PTM of S100A9 can include oxidation(M) (QLS-FEEFIM[147]LMAR (SEQ ID NO:26)). PTM of SAA can include citrullination (FFGHGAEDSLADQAANEWGR[157](SEQ ID NO:27), GPGGVWAAEAISDAR[157] (SEQ ID NO:28)). PTM of semenogelin-1 (SEMG1) can include citrullination (HLAQHLNNDR[157] (SEQ ID NO:29), HLGGSQQLLHNKQEGR[157] (SEQ ID NO:30)) and citrullination and phosphoryaltion (GES[167]GQ[129]S[167]T[181]N[115]R[157] (SEQ ID NO:31)). Antibodies specific to each of the PTMs shown in Table 6 and Examples 2-4 can be used.

One aspect of the invention is a kit for detecting whether a subject is likely to have myocardial ischemia, comprising one or more agents for detecting the amount of a protein of the invention. In addition, other markers for ischemia (e.g., as discussed elsewhere herein) can also be present in a kit. If mass spectrometry is to be used to measure protein levels, the following reagents can be included in the kit: known amounts of a labeled (e.g., stable isotope) peptide (synthetic or recombinant) standard for each peptide to be assessed, separately or combined into a single mixture containing all peptides; optionally, a different peptide standard for assessing reproducibility of the assay; and/or, optionally, dilutant and trypsin for preparation of the sample. If an antibody-based method is to be used to measure protein levels, the agents in the kit can encompass antibodies specific for the proteins. The kit may also include additional agents suitable for detecting, measuring and/or quantitating the amount of protein, including conventional analytes for creation of standard curves. Among other uses, kits of the invention can be used in experimental applications. A skilled worker will recognize components of kits suitable for carrying out a method of the invention.

Optionally, a kit of the invention may comprise instructions for performing the method. Optional elements of a kit of the invention include suitable buffers, containers, or packaging materials. The reagents of the kit may be in containers in which the reagents are stable, e.g., in lyophilized form or stabilized liquids. The reagents may also be in single use form, e.g., for the performance of an assay for a single subject. In one embodiment of the invention, the kit is a "home chest pain test kit," that can be used to test blood, urine, or other body fluids for the presence (and/or level) of protein markers of the invention. Thus, a patient who has been released from an Emergency Department (ED) or a cardiac ward, but who is at risk over the next about 48 hours, can take the test over time at home and, if the test produces positive results, return to the ED.

The ELISA kit may comprise a solid support, such as a chip, microtiter plate (e.g., a 96-well plate), bead, or resin having biomarker capture reagents attached thereon. The kit may further comprise a means for detecting the biomarkers, such as antibodies, and a secondary antibody-signal complex such as horseradish peroxidase (HRP)-conjugated goat anti-rabbit IgG antibody and tetramethyl benzidine (TMB) as a substrate for HRP.

The kit for qualifying myocardial injury status may be provided as an immuno-chromatography strip comprising a membrane on which the antibodies are immobilized, and a means for detecting, e.g., gold particle bound antibodies, where the membrane, includes NC membrane and PVDF membrane. The kit may comprise a plastic plate on which a sample application pad, gold particle bound antibodies temporally immobilized on a glass fiber filter, a nitrocellulose membrane on which antibody bands and a secondary antibody band are immobilized and an absorbent pad are positioned in a serial manner, so as to keep continuous capillary flow of blood serum.

In certain embodiments, a patient can be diagnosed by adding blood or blood serum from the patient to the kit and detecting the relevant biomarkers conjugated with antibodies, specifically, by a method which comprises the steps of: (i) collecting a biological sample (e.g., blood or blood serum) from the patient; (ii) separating blood serum from the patient's blood; (iii) adding the blood serum from patient to a diagnostic kit; and, (iv) detecting the biomarkers conjugated with antibodies. In this method, the antibodies are brought into contact with the patient's blood. If the biomarkers are present in the sample, the antibodies will bind to the sample, or a portion thereof. In other kit and diagnostic embodiments, blood or blood serum need not be collected from the patient (i.e., it is already collected). Moreover, in other embodiments, the sample may comprise a tissue sample or a clinical sample.

The kit can also comprise a washing solution or instructions for making a washing solution, in which the combination of the capture reagents and the washing solution allows capture of the biomarkers on the solid support for subsequent detection by, e.g., antibodies or mass spectrometry. In a further embodiment, a kit can comprise instructions for suitable operational parameters in the form of a label or separate insert. For example, the instructions may inform a consumer about how to collect the sample, how to wash the probe or the particular biomarkers to be detected, etc. In yet another embodiment, the kit can comprise one or more containers with biomarker samples, to be used as standard(s) for calibration.

In another specific embodiment, the kit is provided as a PCR kit comprising primers that specifically bind to one or more of the nucleic acid biomarkers described herein. Primers the specifically bind and amplify the target biomarkers described herein include, but are not limited to, one or more of GM-CSF, IL-10, IL-2, IL-6, IL-8, TNFa, TnI, S100A9, PRD2, LTF, Exostosin-like 2, cDNAFLI53119, highly similar to ADP-ribosyl cyclase 1 (EC 3.2.2.5), Protein S100-A12, Cysteine and glycine-rich protein 1, Isoform of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Prolactin-inducible protein, Isoform VCAM-6D of Vascular cell adhesion protein 1, Caspase-14, Regulator of G-protein signaling 19, Cathelcidin antibmicrobial peptide, Desmoglein-1, Protein-glutamine gamma-glytamyltransferase E, Bleomycin hydrolase, Protein FAM136A, Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, Ig gamma-2 chain C region, Myoglobin, Semenogelin-1, Chromogranin-A, Histone H4, Histone H1.4, Protein S100-A7, Apolipoprotein A-II, Carbonic anhydrase 1, Insulin-like growth factor-binding protein 1, cDNA FLI75188, highly similar to *Homo sapiens* matrillin 2, transcript variant 2, mRNA, SAA, sICAM, sVCAM, CRP, NTproBNP, IFNg, IL-12p70, IL-1b, EMC, and LUM. The kit can further comprise substrates and other reagents necessary for conducting PCR (e.g., quantitative real-time PCR). The kit can be configured to conduct singleplex or multiplex PCR. The kit can further comprise instructions for carrying out the PCR reaction(s). In specific embodiments, the biological sample obtained from a subject may be manipulated to extract nucleic acid. In a further embodiment, the nucleic acids are contacted with primers that specifically bind the target biomarkers to form a primer: biomarker complex. The complexes can then be amplified and detected/quantified/measured to determine the levels of one or more biomarkers. The subject can then be identified as having myocardial injury based on a comparison of the measured levels of one or more biomarkers to one or more reference controls.

Without further elaboration, it is believed that one skilled in the art, using the preceding description, can utilize the present invention to the fullest extent. The following examples are illustrative only, and not limiting of the remainder of the disclosure in any way whatsoever.

Examples

The following examples are put forth so as to provide those of ordinary skill in the art with a complete disclosure and description of how the compounds, compositions, articles, devices, and/or methods described and claimed herein are made and evaluated, and are intended to be purely illustrative and are not intended to limit the scope of what the inventors regard as their invention. Efforts have been made to ensure accuracy with respect to numbers (e.g., amounts, temperature, etc.) but some errors and deviations should be accounted for herein. Unless indicated otherwise, parts are parts by weight, temperature is in degrees Celsius or is at ambient temperature, and pressure is at or near atmospheric. There are numerous variations and combinations of reaction conditions, e.g., component concentrations, desired solvents, solvent mixtures, temperatures, pressures and other reaction ranges and conditions that can be used to optimize the product purity and yield obtained from the described process. Only reasonable and routine experimentation will be required to optimize such process conditions.

Example 1: Cardiac Injury Markers Validated Via Multiple Methodologies and Multiple Cohorts Table I summarizes the results of 67 cardiac injury proteins measured with multiple approaches (proteomic spectra counting via orbitrap, MRM via QTRAP and antibody based multiple technology platforms, ELISA, multiplex, singleplexed and clinical antibody based assay).

TABLE 1

Cardiac Injury Markers

| | Valve I Replacement Cohort | | | Emergency Department | | | Emergency Department | | |
|---|---|---|---|---|---|---|---|---|---|
| | Relative | | | | | | | | |
| | quantita- | | | MO | UA | NCCP | | | |
| Marker | tion via label-free LC MS/MS detect elevated in CPB > 100% | Absolute quanti- tation via MRM detect elevated in CPB > 100% | Absolute quanti- tation via LISA or clinical assay | Absolute quanti- tation via MRM detect elevated in CPB > 100% | Absolute quanti- tation via MRM detect elevated in CPB > 100% | Absolute quanti- tation via MRM detect elevated in CPB > 100% | MI Absolute quanti- tation via LISA or clinical assay | UA Absolute quanti- tation via LISA or clinical assay | NCCP Absolute quanti- tation via LISA or clinical assay |
| GM-CSF | | | Yes | | | | | | |
| IL-10 | | | Yes | | | | | | |
| IL-2 | | | Yes | | | | | | |
| IL-6 | | | Yes | | | | | | |
| IL-8 | | | Yes | | | | | | |
| TNFa | | | Yes | | | | | | |
| TnI | | | Yes | | | | Yes | No | No |
| S100A9 | Yes | Yes | | Yes? | No | No | | | |
| PRD2 | Yes | Yes | | Yes? | No | No | | | |
| LTF | Yes | Yes | | Yes? | No | No | | | |
| Exostosin-like 2 | Yes | | | | | | | | |
| cDNAFLI53119, highly similar to ADP-ribosyl cyclase 1 (EC 3.2.2.5) | Yes | | | | | | | | |
| Protein S100-A12 | Yes | | | | | | | | |
| Cysteine and glycine-rich protein 1 | Yes | | | | | | | | |
| Isoform of Transmembrane protease serine 4 | Yes | | | | | | | | |
| Transgelin-2 | Yes | | | | | | | | |
| Profilin-1 | Yes | | | | | | | | |
| Matrix metalloproteinase-9 | Yes | | | | | | | | |
| Protein S100-A4 | Yes | | | | | | | | |
| Histone H1.5 | Yes | | | | | | | | |
| Properdin | Yes | | | | | | | | |
| Vasodilator-stimulated phosphoprotein | Yes | | | | | | | | |
| Myosin-7 | Yes | | | | | | | | |
| Myosin-6 | Yes | | | | | | | | |
| MHC class I antigen (Fragment) | Yes | | | | | | | | |
| CD5 antigen-like | Yes | | | | | | | | |
| Cystatin-A | Yes | | | | | | | | |
| Cathepsin L1 | Yes | | | | | | | | |

TABLE 1-continued

Cardiac Injury Markers

| Marker | Valve I Replacement Cohort Relative quantitation via label-free LC MS/MS detect elevated in CPB > 100% | Absolute quantitation via MRM detect elevated in CPB > 100% | Absolute quantitation via LISA or clinical assay | Emergency Department MO Absolute quantitation via MRM detect elevated in CPB > 100% | UA Absolute quantitation via MRM detect elevated in CPB > 100% | NCCP Absolute quantitation via MRM detect elevated in CPB > 100% | Emergency Department MI Absolute quantitation via LISA or clinical assay | UA Absolute quantitation via LISA or clinical assay | NCCP Absolute quantitation via LISA or clinical assay |
|---|---|---|---|---|---|---|---|---|---|
| Dopamine beta-hydroxylase | Yes | | | | | | | | |
| Histone H2A.Z | Yes | | | | | | | | |
| Proalctin-inducible protein | Yes | | | | | | | | |
| Isoform VCAM-6D of Vascular cell adhesion protein 1 | Yes | | | | | | | | |
| Caspase-14 | Yes | | | | | | | | |
| Regulator of G-protein signaling 19 | Yes | | | | | | | | |
| Cathelcidin antibmicrobial peptide | Yes | | | | | | | | |
| Desmoglein-1 | Yes | | | | | | | | |
| Protein-glutamine gamma-glytamyltransferase E | Yes | | | | | | | | |
| Bleomycin hydrolase | Yes | | | | | | | | |
| Protein FAM136A | Yes | | | | | | | | |
| Protein S100-A6 | Yes | | | | | | | | |
| Isoform H14 of Myeloperoxidase | Yes | | | | | | | | |
| Isoform 2 of Neutrophil gelatinase-associated lipocalin | Yes | | | | | | | | |
| Beta-Ala-His dipeptidase | Yes | | | | | | | | |
| Catalase | Yes | | | | | | | | |
| Desmoplakin | Yes | | | | | | | | |
| Glyceraldehyde-3-phosphate dehydrogenase | Yes | | | | | | | | |
| Ig gamma-2 chain C region | Yes | | | | | | | | |
| Myoglobin | Yes | | | | | | | | |
| Semenogelin-1 | Yes | | | | | | | | |
| Chromogranin-A | Yes | | | | | | | | |
| Histone H4 | Yes | | | | | | | | |
| Histone H1.4 | Yes | | | | | | | | |
| Protein S100-A7 | Yes | | | | | | | | |
| Apolipoprotein A-II | Yes | | | | | | | | |
| Carbonic anhydrase 1 | Yes | | | | | | | | |
| Insulin-like growth factor-binding protein 1 | Yes | | | | | | | | |
| cDNA FLJ75188, highly similar to *Homo sapiens* matrillin 2, transcript variant 2, mRNA | Yes | | | | | | | | |
| SAA | NO | | NO | | | | | | |
| sICAM | | | NO | | | | | | |
| sVCAM | | | NO | | | | | | |
| CRP | NO | | NO | | | | | | |
| NTproBNP | | | NO | | | | | | |
| IFNg | | | NO | | | | | | |
| IL-12p70 | | | NO | | | | | | |
| IL-1b | | | NO | | | | | | |
| EMC | NO | NO | | NO | NO | NO | NO | NO | NO |
| LUM | NO | NO | | NO | NO | NO | NO | NO | NO |

TABLE 2

Cardiac Injury Markers

| Marker | Method | Methodology Principle | Elevated in CPB > 100% |
|---|---|---|---|
| GM-CSF | ELISA | MSD-multiplexed antibody assay | Yes |
| IL-10 | ELISA | MSD-multiplexed antibody assay | Yes |
| IL-2 | ELISA | MSD-multiplexed antibody assay | Yes |
| IL-6 | ELISA | MSD-multiplexed antibody assay | Yes |
| IL-8 | ELISA | MSD-multiplexed antibody assay | Yes |
| TNFa | ELISA | MSD-multiplexed antibody assay | Yes |
| TnI | Clinical assay | Singleplex antibody based | Yes |
| S100A9 | Spectra counting and MRM | LC-MS/MS assay- Orbitra- and QTRAP | Yes |
| PRD2 | Spectra counting and MRM | LC-MS/MS assay- Orbitra- and QTRAP | Yes |
| LTF | Spectra counting and MRM | LC-MS/MS assay- Orbitra- and QTRAP | Yes |
| Exostosin-like 2 | Spectra counting | LC-MS/MS assay-Orbitra | Yes |
| cDNAFLI53119, highly similar to ADP-ribosyl cyclase 1 (EC 3.2.2.5) | Spectra counting | LC-MS/MS assay-Orbitra | Yes |
| Protein S100-A12 | Spectra counting | LC-MS/MS assay-Orbitra | Yes |
| Cysteine and glycine-rich protein 1 | Spectra counting | LC-MS/MS assay-Orbitra | Yes |
| Isoform of Transmembrane protease serine 4 | Spectra counting | LC-MS/MS assay-Orbitra | Yes |
| Transgelin-2 | Spectra counting | LC-MS/MS assay-Orbitra | Yes |
| Profilin-1 | Spectra counting | LC-MS/MS assay-Orbitra | Yes |
| Matrix metalloproteinase-9 | Spectra counting | LC-MS/MS assay-Orbitra | Yes |
| Protein S100-A4 | Spectra counting | LC-MS/MS assay-Orbitra | Yes |
| Histone H1.5 | Spectra counting | LC-MS/MS assay-Orbitra | Yes |
| Properdin | Spectra counting | LC-MS/MS assay-Orbitra | Yes |
| Vasodilator-stimulated phosphoprotein | Spectra counting | LC-MS/MS assay-Orbitra | Yes |
| Myosin-7 | Spectra counting | LC-MS/MS assay-Orbitra | Yes |
| Myosin-6 | Spectra counting | LC-MS/MS assay-Orbitra | Yes |
| MHC class I antigen (Fragment) | Spectra counting | LC-MS/MS assay-Orbitra | Yes |
| CD5 antigen-like | Spectra counting | LC-MS/MS assay-Orbitra | Yes |
| Cystatin-A | Spectra counting | LC-MS/MS assay-Orbitra | Yes |
| Cathepsin L1 | Spectra counting | LC-MS/MS assay-Orbitra | Yes |
| Dopamine beta-hydroxylase | Spectra counting | LC-MS/MS assay-Orbitra | Yes |
| Histone H2A.Z | Spectra counting | LC-MS/MS assay-Orbitra | Yes |
| Proalctin-inducible protein | Spectra counting | LC-MS/MS assay-Orbitra | Yes |
| Isoform VCAM-6D of Vascular cell adhesion protein 1 | Spectra counting | LC-MS/MS assay-Orbitra | Yes |
| Caspase-14 | Spectra counting | LC-MS/MS assay-Orbitra | Yes |
| Regulator of G-protein signaling 19 | Spectra counting | LC-MS/MS assay-Orbitra | Yes |
| Cathelcidin antibmicrobial peptide | Spectra counting | LC-MS/MS assay-Orbitra | Yes |
| Desmoglein-1 | Spectra counting | LC-MS/MS assay-Orbitra | Yes |
| Protein-glutamine gamma-glytamyltransferase E | Spectra counting | LC-MS/MS assay-Orbitra | Yes |
| Bleomycin hydrolase | Spectra counting | LC-MS/MS assay-Orbitra | Yes |
| Protein FAM136A | Spectra counting | LC-MS/MS assay-Orbitra | Yes |
| Protein S100-A6 | Spectra counting | LC-MS/MS assay-Orbitra | Yes |
| Isoform H14 of Myeloperoxidase | Spectra counting | LC-MS/MS assay-Orbitra | Yes |
| Isoform 2 of Neutrophil gelatinase-associated lipocalin | Spectra counting | LC-MS/MS assay-Orbitra | Yes |
| Beta-Ala-His dipeptidase | Spectra counting | LC-MS/MS assay-Orbitra | Yes |
| Catalase | Spectra counting | LC-MS/MS assay-Orbitra | Yes |
| Desmoplakin | Spectra counting | LC-MS/MS assay-Orbitra | Yes |
| Glyceraldehyde-3-phosphate dehydrogenase | Spectra counting | LC-MS/MS assay-Orbitra | Yes |
| Ig gamma-2 chain C region | Spectra counting | LC-MS/MS assay-Orbitra | Yes |
| Myoglobin | Spectra counting | LC-MS/MS assay-Orbitra | Yes |
| Semenogelin-1 | Spectra counting | LC-MS/MS assay-Orbitra | Yes |
| Chromogranin-A | Spectra counting | LC-MS/MS assay-Orbitra | Yes |
| Histone H4 | Spectra counting | LC-MS/MS assay-Orbitra | Yes |

TABLE 2-continued

Cardiac Injury Markers

| Marker | Method | Methodology Principle | Elevated in CPB > 100% |
| --- | --- | --- | --- |
| Histone H1.4 | Spectra counting | LC-MS/MS assay-Orbitra | Yes |
| Protein S100-A7 | Spectra counting | LC-MS/MS assay-Orbitra | Yes |
| Apolipoprotein A-II | Spectra counting | LC-MS/MS assay-Orbitra | Yes |
| Carbonic anhydrase 1 | Spectra counting | LC-MS/MS assay-Orbitra | Yes |
| Insulin-like growth factor-binding protein 1 | Spectra counting | LC-MS/MS assay-Orbitra | Yes |
| cDNA FLJ75188, highly similar to Homo sapiens matrillin 2, transcript variant 2, mRNA | Spectra counting | LC-MS/MS assay-Orbitra | Yes |
| SAA | Spectra counting and ELISA | MSD-multiplexed antibody assay and LC-MS/MS assay-Orbitra | No |
| sICAM | ELISA | MSD-multiplexed antibody assay | No |
| sVCAM | ELISA | MSD-multiplexed antibody assay | No |
| CRP | Clinical assay and Spectra counting | MSD-multiplexed antibody assay and non-labeling spectra counting via LC-MS/MS assay-Orbitra | No |
| NTproBNP | Clinical assay | Singleplex antibody based | No |
| IFNg | ELISA | | No |
| IL-12p70 | ELISA | | No |
| IL-1b | ELISA | | No |
| EMC | Spectra counting and MRM | LC-MS/MS assay-Orbitra- and QTRAP | No |
| LUM | Spectra counting and MRM | LC-MS/MS assay-Orbitra and QTRAP | No |

TABLE 3

| Acc IDs (All) | Protein Description (All) | Marker classification | Protein Description (All) | rank | ID | Symbol | Entrez Gene Name | Location | Type(s) |
| --- | --- | --- | --- | --- | --- | --- | --- | --- | --- |
| Q9UBQ6; B4DNZ2; C9IYF5; C9JEG3; D3DT60; Q05DH5; Q49A43; Q8IYF4; Q8N8F1 | Exostosin-like 2 | I | EXTL2 | 1 | EXTL2 | EXTL2 | exostoses (multiple)-like 2 | Cytoplasm | enzyme |
| B4E006 | cDNA FLJ53119, highly similar to ADP-ribosyl cyclase 1 (EC 3.2.2.5) | I | CD38 | 2 | CD38 | CD38 | CD38 molecule | Plasma Membrane | enzyme |
| P80511 | Protein S100-A12 | I | S100A12 | 3 | S100A12 | S100A12 | S100 calcium binding protein A12 | Cytoplasm | other |
| P21291; A8K268; B4DY28; B4E2T4; Q59EQ5; Q5U0J2; Q6ZMS3; Q9BTA4 | Cysteine and glycine-rich protein 1 | I | CSRP1 | 4 | CSRP1 | CSRP1 | cytseine and glycine-rich protein 1 | Nucleus | other |
| Q9NRS4-2; Q9NRS4-3; Q9NRS4; A8K2U6; A8MYM4; B7Z8X1; B7Z900 | Isoform 2 of Transmembrane protease serine 4 | I | TMPRSS4 | 5 | TMPRSS4 | TMPRSS4 | transmembrane protease, serine 4 | Plasma Membrane | peptidase |
| P378025 | Transgelin-2 | I | TAGLN2 | 6 | TAGLN2 | TAGLN2 | transgelin 2 | Cytoplasm | other |
| P07737; Q56Y44 | Profillin-1 | I | PFN1 | 7 | PFN1 | PFN1 | profilin 1 | Cytoplasm | other |

TABLE 3-continued

| Acc IDs (All) | Protein Description (All) | Marker classi- fication | Protein Description (All) | rank | ID | Symbol | Entrez Gene Name | Location | Type(s) |
|---|---|---|---|---|---|---|---|---|---|
| P14780; B7Z747 | Matrix metalloproteinase-9 | I | MMP9 | 8 | MMP9 | MMP9 | B, 92 kDa gelatinase, 92 kDa type IV collagenase) | Extracellular Space | peptidase |
| P26447; D3DV46 | Protein S100-A4 | I | S100A4 | 9 | S100A4 | S100A4 | S100 calcium binding protein A4 | Cytoplasm | other |
| P16401 | Histone H1.5 | I | HIST1H1B | 10 | HIST1H1B | HIST1H1B | histone cluster 1, H1b | Nucleus | other |
| P27918 | Properdin | I | CFP | 11 | CFP | CFP | complement factor properdin | Extracellular Space | other |
| P50552 | Vasodilator-stimulated phosphoprotein | I | VASP | 12 | VASP | VASP | phosphoprotein | Plasma Membrane | other |
| P12883 | Myosin-7 | I | MYH7 | 13 | MYH7 | MYH7 | beta | Cytoplasm | enzyme |
| P13533; D9YZU2 | Myosin-6 | I | MYH6 | 14 | MYH6 | MYH6 | myosin, heavy chain 6, cardiac muscle, alpha | Cytoplasm | enzyme |
| D7NNN8; D7NNP3; Q05G04 | MHC class I antigen (Fragment) | I | HLA-A | 15 | HLA-A | HLA-A | major histocompatibility complex, class I, A | Plasma Membrane | trans- membrane receptor |
| O43866 | CD5 antigen-like | I | CD5L | 16 | CD5L | CD5L | CD5 molecule-like | Plasma Membrane | receptor |
| P01040; C9J0E4; Q6IB90 | Cystatin-A | I | CSTA | 17 | CSTA | CSTA | cystatin A (stefin A) | Cytoplasm | other |
| P07711; A5PLM9; B3KQK4; Q5T8F0 | Cathepsin L1 | I | CTSL1 | 18 | CTSL1 | CTSL1 | cathespin L1 | Cytoplasm | peptidase |
| P09172 | Dopamine beta- hydroxylase | I | DBH | 19 | DBH | DBH | dopamine beta- hydroxylase (dopamine beta- monooxygenase) | Cytoplasm | peptidase |
| P0C0S5; Q71UI9; A6NN01; C9J0D1 | Histone H2A.Z | I | H2AFZ | 20 | H2AFZ | H2AFZ | H2A histone family, member z | Nucleus | other |
| P12273 | Prolactin-inducible protein | I | PIP | 21 | PIP | PIP | prolactin-induced protein | Extracellular Space | other |
| P19320-2; P19320; B4DKS4; Q53FL7 | Isoform VCAM-6D of Vascular cell adhesion protein 1 | I | VCAM1 | 22 | VCAM1 | VCAM1 | vacular cell adhesion molecule 1 | Plasma Membrane | other |
| P31944; B2CIS9 | Caspase-14 | I | CASP14 | 23 | CASP14 | CASP14 | capase 14, apoptosis-related cystein peptidase | Cytoplasm | peptidase |
| P49795; B4DP94; Q619S5 | Regulator of G-protein signalling 19 | I | RGS19 | 24 | RGS19 | RGS19 | regulator of G- protein signaling 19 | Cytoplasm | peptidase |
| P49913 | Cathelicidin antimicrobial peptide | I | CAMP | 25 | CAMP | CAMP (includes EG: 12796) | cathelicidin antimicrobial peptide | Cytoplasm | other |
| Q02413 | Desmoglein-1 | I | DSG1 | 26 | DSG1 | DSG1 | desmoglein 1 | Plasma Membrane | other |
| Q08188; B4DQ50; D3DVX1 | Protein-glutamine gamma- glutamyltransferase E | I | TGM3 | 27 | TGM3 | TGM3 | transglutaminase 3 (E polypeptide, protein-glutamine- gamma- glutamyltransferase) | Cytoplasm | enzyme |
| Q13867 | Bleomycin hydrolase | I | BLMH | 28 | BLMH | BLMH | bleomycin hydrolase | Cytoplasm | peptidase |
| Q96C01; B0AZT6; C9JF51 | Protein FAM136A | I | FAM136A | 29 | FAM136A | FAM136A | family with sequence similarity 136, member A | Cytoplasm | other |
| P06703; D3DV39 | Protein S100-A6 | II | S100A6 | 30 | S100A6 | S100A6 | S100 calcium binding protein A6 | Cytoplasm | transporter |
| P05164-2; P05164-3; P05164 | Isoform H14 of Myeloperoxidase | II | MPO | 31 | MPO | MPO | myeloperoxidase | Cytoplasm | enzyme |
| P80188-2; P80188; B2ZDQ1 | Isoform 2 of Neutrophil gelatinase-associated lipocalin | II | LCN2 | 32 | LCN2 | LCN2 | lipocalin 2 | Extracellular Space | transporter |
| Q96KN2; A8K1K1; B4E180 | Bata-Ala-His-dipeptidase | II | CNDP1 | 33 | CNDP1 | CNDP1 | carnosine dipeptidase 1 (metallopeptidase M20 family) | Cytoplasm | peptidase |
| P04040; D3DR07 | Catalase | II | CAT | 34 | CAT | CAT | catalase | Cytoplasm | enzyme |

TABLE 3-continued

| Acc IDs (All) | Protein Description (All) | Marker classification | Protein Description (All) | rank | ID | Symbol | Entrez Gene Name | Location | Type(s) |
|---|---|---|---|---|---|---|---|---|---|
| P15924 | Desmoplakin | II | DSP | 35 | DSP | DSP | desmoplakin | Plasma Membrane | other |
| P04406; Q2TSD0 | Glyceraldehyde-3-phosphate dehydrogenase | II | GAPDH | 36 | GAPDH | GAPDH | glyceraldehyde-3-phosphate dehydrogenase | Cytoplasm | enzyme |
| P01859 | Ig gamma-2 chain C region | II | IGHG2 | 37 | IGHG2 | IGHG2 | immunoglobulin heavy constant gamma 2 (G2m marker) | Plasma Membrane | other |
| P02144; B2RA67 | Myoglobin | II | MB | 38 | MB | MB | myoglobin | Cytoplasm | transporter |
| P06702; D3DV36 | Protein S100-A9 | II | S100A9 | 39 | S100A9 | S100A9 | S100 calcium binding protein A9 | Cytoplasm | other |
| P04279 | Semenogelin-1 | II | SEMG1 | 40 | SEMG1 | SEMG1 | semenogelin I | Extracellular Space | other |
| P10645 | Chromogranin-A | II | CHGA | 41 | CHGA | CHGA | chromogranin A (parathyroid secretory protein 1) | Extracellular Space | other |
| P62805; B2R4R0; Q0VAS5 | Histone 4 | II | HIST1H4A | 42 | HIST1H4A | HIST1H4A (includes others) | histone cluster 1, H4a | Nucleus | other |
| P10412; P16402; P16403; A3R0T7; A3R0T8; A8K412; B2R984; Q4VB24 | Histone H1.4 | II | HIST1H1E | 43 | HIST1H1E | HIST1H1E | histone cluster 1, H1e | Nucleus | other |
| P31151 | Protein S100-A7 | II | S100A7 | 44 | S100A7 | S100A7 | S100 calcium binding protein A7 | Cytoplasm | other |
| P02652 | Apolipoprotein A-II | II | APOA2 | 45 | APOA2 | APOA2 | apolipoprotein A-II | Extracellular Space | transporter |
| P00915 | Carbonic anhydrase 1 | II | CA1 | 46 | CA1 | CA1 | carbonic anhydrase I | Cytoplasm | enzyme |
| Q2TUW9 | Lactoferrin | II | LTF | 47 | LTF | LTF | lactotransferrin | Extracellular Space | peptidase |
| P08833; C1K3N3; C9JXF9; D3DVL9; Q6PEY6 | Insulin-like growth factor-binding protein 1 | II | IGFBP1 | 48 | IGFBP1 | IGFBP1 (includes EG: 16006) | insulin-like growth factor binding protein 1 | Extracellular Space | other |
| A8K106 | cDNA FLJ75188, highly similar to Homo sapiens matrillin 2, transcript variant 2, mRNA | II | MATN2 | 49 | MATN2 | MATN2 | matrilin 2 | Extracellular Space | other |
| P32119; B4DF70 | Peroxiredoxin-2 | II | PRDX2 | 50 | PRDX2 | PRDX2 | peroxiredoxin 2 | Cytoplasm | enzyme |

TABLE 4

Pathway and Pathological Functions of Certain Marker Proteins

| Pathways and Pathological functions | Molecules |
|---|---|
| Oxidative Stress | S100A7, VCAM1, S100A9, CAT, MPO, PRDX2 |
| Cardiac Hypertrophy | S100A6, MYH6, MB, CHGA, MYH7, H2AFZ, MMP9 |
| Acute Renal Failure Panel (Rat) | VCAM1, LCN2, IGFBP1 (includes EG: 16006) |
| Genes associated with Chronic Allograft Nephropathy (Human) | VCAM1, MMP9 |
| Increases Cardiac Dilation | MPO, MMP9 |
| Cardiac Necrosis/Cell Death | CAT, LCN2, MPO, DSP |
| Persistent Renal Ischemia-Reperfusion Injury (Mouse) | VCAM1, LCN2 |
| Cardiac Fibrosis | MYH6, MMP9, DSP |
| Negative Acute Phase Response Proteins | APOA2 |
| VDR/RXR Activation | CAMP (includes EG: 12796), IGFBP1 (includes EG: 16006) |
| Decreases Depolarization of Mitochondria and Mitochondrial Membrane | CAT |
| Hepatic Fibrosis | IGFBP1 (includes EG: 16006), MMP9 |

TABLE 4-continued

Pathway and Pathological Functions of Certain Marker Proteins

| Pathways and Pathological functions | Molecules |
|---|---|
| Decreases Transmembrane Potential of Mitochondria and Mitochondrial Membrane | CAMP (includes EG: 12796), CAT |
| Increases Renal Proliferation | CAMP (includes EG: 12796), LCN2 |
| Recovery from Ischemic Acute Renal Failure (Rat) | S100A4 |
| Increases Heart Failure | MMP9 |
| Long-term Renal Injury Anti-oxidative Response Panel (Rat) | CAT |
| LXR/RXR Activation | APOA2, MMP9 |
| Renal Proximal Tubule Toxicity Biomarker Panel (Rat) | IGFBP1 (includes EG: 16006) |
| Increases Cardiac Dysfunction | MMP9 |
| Increases Renal Nephritis | MPO |
| Increases Transmembrane Potential of Mitochondria and Mitochondrial Membrane | CAT |
| Liver Necrosis/Cell Death | IGFBP1 (includes EG: 16006), MMP9 |
| PXR/RXR Activation | IGFBP1 (includes EG: 16006) |
| Increases Liver Damage | MMP9 |
| Mechanism of Gene Regulation by Peroxisome Proliferators via PPARα | APOA2 |
| Renal Necrosis/Cell Death | CAT, LCN2 |
| Mitochondrial Dysfunction | CAT |
| PPARα/RXRα Activation | APOA2 |
| Liver Proliferation | IGFBP1 (includes EG: 16006) |
| NRF2-mediated Oxidative Stress Response | CAT |
| LPS/IL-1 Mediated Inhibition of RXR Function | CAT |

Multiple post translational modifications are found in 13 markers. The PTM include citrullination, oxidation and/or phosphorylation of carbonic anhydrase 1(CA1), cysteine and glycine-rich protein 1(CAT1), properdin (CFP), desmioplakin (DSP), extracellular matrix protein 1(EMC1), lactoferrin (LTF), lumican (LUM), myosin-7 (MYH7), peroxiredoxin-2 (PRDX2), S100A7, S100A9, SAA1, and semenogelin-1 (SEMG1). Table 5 listed the nature of the modification site and peptides sequence of these 13 markers.

TABLE 5

PTMs of Markers in Cardiac Injury Cohort

| Gene | PTM | Modified Peptide | Sum of sc |
|---|---|---|---|
| CA1 | Cit | ESISVSSEQLAQFR[157] (SEQ ID NO: 1) | 3.92 |
|  | Cit | SLLSNVEGDNAVPMQHNNR[157]PTQPLK (SEQ ID NO: 2) | 15.84 |
| CAT | Cit | NAIHTFVQSGSHLAAR[157] (SEQ ID NO: 3) | 21 |
|  | Oxi (M) | HM[147]N[115]GYGSHTFK (SEQ ID NO: 4) | 35 |
| CFP | Oxi (M) | YPPTVSM[147]VEGQGEK (SEQ ID NO: 5) | 2429 |
| DSP | Cit | IGLVR[157]PGTALELLEAQAATGFIVDPVSNLR (SEQ ID NO: 6) | 21.87 |
| ECM1 | Cit | DILTIDIGR [157] (SEQ ID NO: 7) | 0.99 |
|  | Cit | LVWEEAMSR[157] (SEQ ID NO: 8) | 0.99 |
|  | Cit | NLPATDPLQR[157] (SEQ ID NO: 9) | 0.99 |
|  | Cit | QGETLNFLEIGYSR[157] (SEQ ID NO: 10) | 2.94 |
|  | Cit | QHVVYGPWNLPQSSYSHLTR[157] (SEQ ID NO: 11) | 2.94 |
|  | Cit, Phospho | Q[129]HVVYGPWN[115]LPQ[129]S[167]S[167]Y[243]S[167]HLT[181]R[157] (SEQ ID NO: 12) | 1.96 |
| LTF | Cit | IDSGLYLGSGYFTAIQNLR[157] (SEQ ID NO: 13) | 17.89 |
|  | Cit | VPSHAVVAR[157] (SEQ ID NO: 14) | 5.92 |
|  | Phospho | S[167]DT[181]S[167]LT[181]W[202]N[115]S[167]VK (SEQ ID NO: 15) | 6 |
| LUM | Cit | FN[115]ALQ[129]YLR[157] (SEQ ID NO: 16) | 10 |
|  | Cit | FNALQYLR[157] (SEQ ID NO: 17) | 1 |
|  | Cit | SLEYLDLSFNQIAR[157] (SEQ ID NO: 18) | 28 |

TABLE 5-continued

PTMs of Markers in Cardiac Injury Cohort

| Gene | PTM | Modified Peptide | Sum of sc |
|---|---|---|---|
| MYH7 | Oxi (M) | IEDMAM[147]LTFLHEPAVLYNLK (SEQ ID NO: 19) | 162.63 |
| PRDX2 | Cit | EGGLGPLNIPLLADVTR[157] (SEQ ID NO: 20) | 3 |
|  | Cit | R[157]LSEDYGVLK (SEQ ID NO: 21) | 3 |
|  | Cit | TDEGIAYR[157] (SEQ ID NO: 22) | 58 |
| S100A7 | Oxi (M) | SIIGM[147]IDM[147]FHK (SEQ ID NO: 23) | 181 |
|  | Oxi (M) | SIIGMIDM[147]FHK (SEQ ID NO: 24) | 71 |
|  | Phospho | Q[112]S[167]HGAAPCS[167]GGS[167]Q[129] (SEQ ID NO: 25) | 6 |
| S100A9 | Oxi (M) | QLSFEEFIM[147]LMAR (SEQ ID NO: 26) | 2131 |
| SAA1 | Cit | FFGHGAEDSLADQAANEWGR[157] (SEQ ID NO: 27) | 9.98 |
|  | Cit | GPGGVWAAEAISDARV[157] (SEQ ID NO: 28) | 25 |
| SEMG1 | Cit | HLAQHLNNDR[157] (SEQ ID NO: 29) | 14 |
|  | Cit | HLGGSQQLLHNKQEGR[157] (SEQ ID NO: 30) | 1 |
|  | Cit, Phospho | GES[167]GQ[129]S[167]T[181]N[115]R[157] (SEQ ID NO: 31) | 1.99 |

Table 6 below summarizes the specific post translational modification, site and peptide sequence of carbonic anhydrase 1(CA1), cysteine and glycine-rich protein 1(CAT1), properdin (CFP), desmoplakin (DSP), extracellular matrix protein 1(EMC1), lactoferrin (LTF), lumican (LUM), myosin-7 (MYH7), peroxiredoxin-2 (PRDX2), S100A7, S100A9, SAA1, and semenogelin-1 (SEMG1).

TABLE 6

PTMs founds in Multiple Human Cohort

| Gene | Modification | modified_peptide | Sum of sc |
|---|---|---|---|
| APOA2 | Oxi(M) | DLM[147]EKVKSPELQAEAK (SEQ ID NO: 32) | 12.02 |
|  | Oxi(M) | EPCVESLVSQYFQTVTDYGKDLM[147]EK (SEQ ID NO: 33) | 14 |
|  | Oxi(M) | Q[111]AKEPCVESLVSQYFQTVTDYGKDLM[147]EK (SEQ ID NO: 34) | 149 |
|  | Phospho | E[111]PCVES[167]LVSQYFQTVTDYGK (SEQ ID NO: 35) | 223 |
|  | Phospho | EQLT[181]PLIKK (SEQ ID NO: 36) | 2 |
| BLMH | Oxi(M) | E[111]HVKPLFNM[147]EDK (SEQ ID NO: 37) | 2.97 |
|  | Oxi(M) | EHVKPLFNM[147]EDK (SEQ ID NO: 38) | 14.91 |
|  | Oxi(M) | GEISATQDVM[147]M[147]EEIFR (SEQ ID NO: 39) | 12.02 |
|  | Oxi(M) | GEISATQDVMM[147]EEIFR (SEQ ID NO: 40) | 1.01 |
|  | Oxi(M) | LGLSDM[147]NLYDHELVFGVSLK (SEQ ID NO: 41) | 18.98 |
|  | Oxi(M) | LVQFLLM[147]NPANDGGQWDM[147]LVNIVEK (SEQ ID NO: 42) | 1 |
|  | Oxi(M) | LVQFLLM[147]NPANDGGQWDMLVNIVEKYGVIPKK (SEQ ID NO: 43) | 2 |
|  | Oxi(M) | LYTVEYLSNM[147]VGGR (SEQ ID NO: 44) | 27.92 |
|  | Oxi(M) | LYTVEYLSNM[147]VGGRK (SEQ ID NO: 45) | 0.99 |
| CA1 | Cit | EIINVGHSFHVNLEDNDNR[157] (SEQ ID NO: 46) | 28.15 |
|  | Cit | ESISVSSEQLAQFR[157] (SEQ ID NO: 1) | 3.92 |
|  | Cit | SLLSNVEGDNAVPMQHNNR[157]PTQPLK (SEQ ID NO: 2) | 15.84 |
|  | Oxi(M) | ADGLAVIGVLM[147]K (SEQ ID NO: 47) | 1651.71 |
|  | Oxi(M) | M[147]ASPDWGYDDK (SEQ ID NO: 48) | 1.92 |
|  | Oxi(M) | M[147]TKMLHVAHWNSAK (SEQ ID NO: 49) | 9.08 |
|  | Oxi(M) | MTKM[147]LHVAHWNSAK (SEQ ID NO: 50) | 22.18 |
|  | Oxi(M) | SLLSNVEGDNAVPM[147]QHNNRPTQPLK (SEQ ID NO: 51) | 2069.64 |
| CAMP | Cit | ETVCPR[157]TTQQ[129]SPEDCDFKK (SEQ ID NO: 52) | 5 |
|  | Cit | ETVCPR[157]TTQQSPEDCDFK (SEQ ID NO: 53) | 5 |
|  | Cit | ETVCPR[157]TTQQSPEDCDFKK (SEQ ID NO: 54) | 4 |
|  | Cit | RCMGTVTLNQ[129]AR[157]GSFDISCDK (SEQ ID NO: 55) | 7 |
|  | Oxi(M) | CM[147]GTVTLNQAR (SEQ ID NO: 56) | 14 |
|  | Oxi(M) | RCM[147]GTVTLNQARGSFDISCDK (SEQ ID NO: 57) | 2 |

TABLE 6-continued

PTMs founds in Multiple Human Cohort

| Gene | Modification | modified_peptide | Sum of sc |
|---|---|---|---|
| CASP14 | Oxi(M) | AREGSEEDLDALEHM[147]FR (SEQ ID NO: 58) | 3 |
| | Oxi(M) | DPGETVGGDEIVM[147]VIK (SEQ ID NO: 59) | 5 |
| | Oxi(M) | EGSEEDLDALEHM[147]FR (SEQ ID NO: 60) | 15 |
| | Oxi(M) | M[147]AEAELVQEGK (SEQ ID NO: 61) | 655 |
| | Oxi(M) | RM[147]AEAELVQEGK (SEQ ID NO: 62) | 5 |
| | Oxi(M) | SLEEEKYDM[147]SGAR (SEQ ID NO: 63) | 3 |
| CAT | Cit | AAQKADVLTTGAGNPVGDKLNVITVGPR[157] (SEQ ID NO: 64) | 9 |
| | Cit | ADVLTTGAGNPVGDKLNVITVGPR[157] (SEQ ID NO: 65) | 16 |
| | Cit | AFYVNVLNEEQRV[157] (SEQ ID NO: 66) | 4.99 |
| | Cit | FNTANDDNVTQVR[157] (SEQ ID NO: 67) | 3.99 |
| | Cit | FSTVAGESGSADTVR[157] (SEQ ID NO: 68) | 7 |
| | Cit | FYTEDGN[115]WDLVGN[115]NTPIFFIR[157] (SEQ ID NO: 69) | 0.99 |
| | Cit | FYTEDGN[115]WDLVGNNTPIFFIR[157] (SEQ ID NO: 70) | 0.99 |
| | Cit | FYTEDGNWDLVGNNTPIFFIR[157] (SEQ ID NO: 71) | 2 |
| | Cit | FYTEDGNWDLVGNNTPIFFIR[157]DPILFPSFIHSQK (SEQ ID NO: 72) | 8 |
| | Cit | GPLLVQDVVFTDEMAHFDR[157] (SEQ ID NO: 73) | 11.99 |
| | Cit | GPLLVQDVVFTDEMAHFDRER[157] (SEQ ID NO: 74) | 3 |
| | Cit | LGPNYLHIPVNCPYR[157] (SEQ ID NO: 75) | 3 |
| | Cit | LSQEDPDYGIR[157] (SEQ ID NO: 76) | 9 |
| | Cit | LVLNR[157]N[115]PVNYFAEVEQIAFDPSNMPPGIEASPDK (SEQ ID NO: 77) | 4 |
| | Cit | LVLNR[157]NPVNYFAEVEQIAFDPSNMPPGIEASPDK (SEQ ID NO: 78) | 1 |
| | Cit | NAIHTFVQSGSHLAAR[157] (SEQ ID NO: 3) | 21 |
| | Cit | NLSVEDAAR[157]LSQEDPDYIR[157]DLFNAIATGK (SEQ ID NO: 79) | 5 |
| | Cit | NLSVEDAAR[157]LSQEDPDYGIRDLFNAIATG (SEQ ID NO: 80) | 1 |
| | Cit | NLSVEDAARLSQ[129]EDPDYGIR[157]DLFNAIATGK (SEQ ID NO: 81) | 4 |
| | Cit | NLSVEDAARLSQEDPDYGIR[157]DLFNAIATGK (SEQ ID NO: 83) | 5 |
| | Cit | RFNTANDDNVTQVR[157] (SEQ ID NO: 84) | 3 |
| | Oxi(M) | DPASDQM[147]QHWK (SEQ ID NO: 85) | 233 |
| | Oxi(M) | DPDM[147]VWDFWSLRPESLHQVSFLFSDR (SEQ ID NO: 86) | 7 |
| | Oxi(M) | GPLLVQDVVFTDEM[147]AHFDR (SEQ ID NO: 87) | 580.32 |
| | Oxi(M) | GPLLVQDVVFTDEM[147]AHFDRER (SEQ ID NO: 88) | 11 |
| | Oxi(M) | HM[147]N[115]GYGSHTFK (SEQ ID NO: 4) | 35 |
| | Oxi(M) | HM[147]NGYGSHTFK (SEQ ID NO: 89) | 62.06 |
| | Oxi(M) | LVLN[115]RN[115]PVN[115]YFAEVEQIAFDPSNM[147]PPGIEASPDK (SEQ ID NO: 90) | 3 |
| | Oxi(M) | LVLNRN[115]PVNYFAEVEQIAFDPSN[115]M[147]PPGIEASPDK (SEQ ID NO: 91) | 5 |
| | Oxi(M) | LVLNRN[115]PVNYFAEVEQIAFDPSNM[147]PPGIEASPDK (SEQ ID NO: 92) | 1 |
| | Oxi(M) | LVLNRNPVNYFAEVEQIAFDPSNM[147]PPGIEASPDK (SEQ ID NO: 93) | 3 |
| | Oxi(M) | n[43]ADSRDPASDQM[147]QHWK (SEQ ID NO: 94) | 101 |
| | Oxi(M) | n[43]ADSRDPASDQM[147]QHWKEQR (SEQ ID NO: 95) | 1 |
| | Oxi(M) | NPQTHLKDPDM[147]VWDFWSLRPESLHQVSFLFSDR (SEQ ID NO: 96) | 2 |
| | Oxi(M) | NPVNYFAEVEQIAFDPSN[115]M[147]PPGIEASPDK (SEQ ID NO: 97) | 1.98 |
| | Oxi(M) | NPVNYFAEVEQIAFDPSNM[147]PPGIEASPDK (SEQ ID NO: 98) | 255.87 |
| | Phospho | LSQEDPDY[243]GIR (SEQ ID NO: 99) | 1 |
| CD38 | Phospho | ELES[167]IISKR (SEQ ID NO: 100) | 5 |
| CD5L | Phospho | LVGGDNLCS[167]GR (SEQ ID NO: 101) | 3 |
| CFP | Oxi(M) | GSWSEWSTWGLCM[147]PPCGPNPTR (SEQ ID NO: 102) | 1 |
| | Oxi(M) | YPPTVSM[147]VEGQ[129]GEK (SEQ ID NO: 103) | 1 |
| | Oxi(M) | YPPTVSM[147]VEGQGEK (SEQ ID NO: 5) | 2429 |
| | Phospho | T[181]HICNT[181]AVPCPVDGEWDS[167]WGEWSPCIR (SEQ ID NO: 104) | 1 |
| CHGA | Oxi(M) | C[143]IVEVISDTLSKPSPM[147]PVSQECFETLR (SEQ ID NO: 105) | 4 |
| | Oxi(M) | CIVEVISDTLSKPSPM[147]PVSQECFETLR (SEQ ID NO: 106) | 1 |
| | Oxi(M) | EEEEEM[147]AVVPQGLFR (SEQ ID NO: 107) | 2 |
| | Oxi(M) | GEQEHSQQKEEEEEM[147]AVVPQGLFR (SEQ ID NO: 108) | 76 |
| | Oxi(M) | LEGQEEEEDNRDSSM[147]K (SEQ ID NO: 109) | 21 |
| | Oxi(M) | LPVNSPM[147]NKGDTE (SEQ ID NO: 110) | 0.99 |
| | Oxi(M) | RLEGQEEEEDNRDSSM[147]K (SEQ ID NO: 111) | 315 |
| | Oxi(M) | SGEATDGARPQALPEPM[147]QESK (SEQ ID NO: 112) | 496 |

TABLE 6-continued

PTMs founds in Multiple Human Cohort

| Gene | Modification | modified_peptide | Sum of sc |
|---|---|---|---|
| | Phospho | GGKS[167]GELEQEEER (SEQ ID NO: 113) | 162 |
| | Phospho | LEGQEEEDNRDS[167]S[167]MKLS[167]FR (SEQ ID NO: 114) | 3 |
| | Phospho | S[167]GELEQEEER (SEQ ID NO: 115) | 3 |
| CNDP1 | Oxi(M) | EEILM[147]HLWR (SEQ ID NO: 116) | 5.01 |
| | Oxi(M) | FIIEGM[147]EEAGSVALEELVEK (SEQ ID NO: 117) | 151.82 |
| | Oxi(M) | GNSYFM[147]VEVK (SEQ ID NO: 118) | 194.46 |
| | Oxi(M) | LFAAFFLEM[147]AQLH (SEQ ID NO: 119) | 4.01 |
| | Oxi(M) | M[147]FQEIVHK (SEQ ID NO: 120) | 189.56 |
| | Oxi(M) | M[147]M[147]AVAADTLQR (SEQ ID NO: 121) | 845.66 |
| | Oxi(M) | M[147]MAVAADTLQR (SEQ ID NO: 122) | 1166.4 |
| | Oxi(M) | M[147]VVSM[147]TLGLHPWIANIDDTQYLAAK (SEQ ID NO: 123) | 41.7 |
| | Oxi(M) | M[147]VVSMTLGLHPWIANIDDTQYLAAK (SEQ ID NO: 124) | 0.99 |
| | Oxi(M) | MiN4[147]AVAADTLQR (SEQ ID NO: 125) | 619.1 |
| | Oxi(M) | MVVSM[147]TLGLHPWIANIDDTQYLAAK (SEQ ID NO: 126) | 8.91 |
| | Oxi(M) | TVFGTEPDM[147]IR (SEQ ID NO: 127) | 1037.35 |
| | Oxi(M) | VASVDM[147]GPQQLPDGQSLPIPPVILAELGSDPIK (SEQ ID NO: 128) | 196 |
| | Phospho | FIIEGMEEAGS[167]VALEELVEK (SEQ ID NO: 129) | 5.96 |
| CSRP1 | Cit | HEEAPGHR[157]PTTNPNASK (SEQ ID NO: 130) | 1.98 |
| | Oxi(M) | SC[160]FLC[160]M[147]VC[160]K (SEQ ID NO: 131) | 4 |
| | Oxi(M) | SC[432]FLC[432]M[147]VC[432]K (SEQ ID NO: 132) | 3 |
| | Oxi(M) | SCFLCM[147]VCK (SEQ ID NO: 133) | 485.69 |
| | Phospho | GFGFGQGAGALVHS[167]E (SEQ ID NO: 134) | 74.94 |
| CSTA | Oxi(M) | M[147]IPGGLSEAKPATPEIQEIVDK (SEQ ID NO: 135) | 3 |
| | Oxi(M) | n[431]M[147]IPGGLSEAK (SEQ ID NO: 136) | 1 |
| | Oxi(M) | n[431]M[147]IPGGLSEAKPATPEIQ[129]EIVDK (SEQ ID NO: 137) | 1 |
| | Oxi(M) | n[431]M[147]IPGGLSEAKPATPEIQEIVDK (SEQ ID NO: 138) | 29 |
| CTSL | Oxi(M) | NSWGEEWGM[147]GGYVK (SEQ ID NO: 139) | 23 |
| DBH | Oxi(M) | AGVLFGM[147]SDR (SEQ ID NO: 140) | 83 |
| | Phospho, Oxi(M) | GNEALVHHM[147]EVFQCAPEM[147]DSVPHFS[167]GPCDS[167]K (SEQ ID NO: 141) | 1 |
| DSG1 | Cit | ASAISVTVLNVIEGPVFR[157]PGSK (SEQ ID NO: 142) | 1 |
| | Oxi(M) | AEFHHSIM[147]SQYK (SEQ ID NO: 143) | 45 |
| | Oxi(M) | ALNSM[147]GQDLERPLELR (SEQ ID NO: 144) | 248 |
| | Oxi(M) | DGGADGM[147]SAECECNIK (SEQ ID NO: 145) | 61 |
| | Oxi(M) | EGGLNM[147]NFM[147]ESYFCQK (SEQ ID NO: 146) | 5 |
| | Oxi(M) | EQYNM[147]LGGK (SEQ ID NO: 147) | 3 |
| | Oxi(M) | GSDRDGGADGM[147]SAECECNIK (SEQ ID NO: 148) | 33 |
| | Oxi(M) | M[147]TGFELTEGVK (SEQ ID NO: 149) | 185 |
| | Oxi(M) | TM[147]NNFLDREQYGQYALAVR (SEQ ID NO: 150) | 309 |
| | Oxi(M) | TSGM[147]PEICQEYSGTLR (SEQ ID NO: 151) | 30 |
| | Oxi(M) | TYVVTGNM[147]GSNDK (SEQ ID NO: 152) | 668 |
| | Oxi(M) | TYVVTGNM[147]GSNDKVGDFVATDLDTGRPSTTVR (SEQ ID NO: 153) | 9 |
| | Oxi(M) | VIQPTSGM[147]IGSLSM[147]HPELANAHNVIVTER (SEQ ID NO: 154) | 4 |
| | Oxi(M) | VVGPISGADLHGM[147]LEM[147]PDLR (SEQ ID NO: 155) | 19 |
| | Oxi(M) | VVGPISGADLHGM[147]LEMPDLR (SEQ ID NO: 156) | 20 |
| | Oxi(M) | VVGPISGADLHGMLEM[147]PDLR (SEQ ID NO: 157) | 31 |
| | Oxi(M) | VVKPLDYEAM[147]QSLQLSIGVR (SEQ ID NO: 158) | 10 |
| | Oxi(M) | YVM[147]GNNPADLLAVDSR (SEQ ID NO: 159) | 1000 |
| | Phospho | S[167]AAGFEINPECSDGAIHSWAVEGPQPEPR (SEQ ID NO: 160) | 2 |
| | Phospho | SSSDHHFNQTIGS[167]ASPSTAR (SEQ ID NO: 161) | 2 |
| | Phospho | SSSDHHFNQTIGSAS[167]PSTAR (SEQ ID NO: 162) | 6 |
| DSP | Cit | AEMDMVAWGVDLASVEQHINSHR[157] (SEQ ID NO: 163) | 0.99 |
| | Cit | IGLVR[157]PGTALELLEAQAATGFIVDPVSNLR (SEQ ID NO: 6) | 21.87 |
| | Cit | IGLVRPGTALELLEAQAATGFIVDPVSNLR[157] (SEQ ID NO: 164) | 0.99 |
| | Cit | LISPESTVMLLEAQAATGGIIDPHR[157] (SEQ ID NO: 165) | 1.98 |
| | Cit | LLEAQIATGGIIDPKESHR[157] (SEQ ID NO: 166) | 1 |
| | Cit | QPVTVTELVDSGILR[157]PSTVNELESGQISYDEVGER (SEQ ID NO: 167) | 1 |
| | Cit | R[157]QDSLESM[147]K (SEQ ID NO: 168) | 4 |
| | Oxi(M) | | |
| | Oxi(M) | AEM[147]DM[147]VAWGVDLASVEQHINSHR (SEQ ID NO: 169) | 25.54 |
| | Oxi(M) | AEM[147]DMVAWGVDLASVEQHINSHR (SEQ ID NO: 170) | 10.78 |
| | Oxi(M) | AEMDM[147]VAWGVDLASVEQHINSHR (SEQ ID NO: 171) | 20.58 |
| | Oxi(M) | ALLQAILQTEDM[147]LK (SEQ ID NO: 172) | 618.17 |

TABLE 6-continued

PTMs founds in Multiple Human Cohort

| Gene | Modification | modified_peptide | Sum of sc |
|---|---|---|---|
| | Oxi(M) | AVTGYNDPETGNIISLFQAM[147]NK (SEQ ID NO: 173) | 223.74 |
| | Oxi(M) | EHLM[147]LEEELR (SEQ ID NO: 174) | 31 |
| | Oxi(M) | ELDEC[407]FAQANDQM[147]EILDSLIR (SEQ ID NO: 175) | 18 |
| | Oxi(M) | ELDECFAQANDQM[147]EILDSLIR (SEQ ID NO: 176) | 7.95 |
| | Oxi(M) | EM[147]SVQEAYK (SEQ ID NO: 177) | 8.91 |
| | Oxi(M) | ENDKQETWMLM[147]ELQK (SEQ ID NO: 178) | 0.98 |
| | Oxi(M) | FGDSNTVM[147]R (SEQ ID NO: 179) | 543.2 |
| | Oxi(M) | GLPSPYNM[147]SSAPGSR (SEQ ID NO: 180) | 34.45 |
| | Oxi(M) | GVITDQNSDGYC[407]QTGTM[147]SR (SEQ ID NO: 181) | 1 |
| | Oxi(M) | GVITDQNSDGYC[432]QTGTM[147]SR (SEQ ID NO: 182) | 2 |
| | Oxi(M) | GVITDQNSDGYCQTGTM[147]SR (SEQ ID NO: 183) | 13.9 |
| | Oxi(M) | HQNQNTIQELLQNC[432]SDC[432]LM[147]R (SEQ ID NO: 184) | 3 |
| | Oxi(M) | HQNQNTIQELLQNCSDCLM[147]R (SEQ ID NO: 185) | 29.91 |
| | Oxi(M) | HVTSECLGWM[147]R (SEQ ID NO: 186) | 0.99 |
| | Oxi(M) | KLEEELEGM[147]R (SEQ ID NO: 187) | 3 |
| | Oxi(M) | LEEELEGM[147] (SEQ ID NO: 188) | 13 |
| | Oxi(M) | LGIYEAM[147]K (SEQ ID NO: 189) | 187.78 |
| | Oxi(M) | LISPESTVM[147]LLEAQAATGGIIDPHR (SEQ ID NO: 190) | 36.65 |
| | Oxi(M) | LISPESTVM[147]LLEAQAATGGIIDPHRNEK (SEQ ID NO: 191) | 0.99 |
| | Oxi(M) | LLQLQEQM[147]R (SEQ ID NO: 192) | 334.21 |
| | Oxi(M) | LSLQDAVSQGVIDQDM[147]ATR (SEQ ID NO: 193) | 43.64 |
| | Oxi(M) | M[147]SQLEVK (SEQ ID NO: 194) | 5.88 |
| | Oxi(M) | N[115]GVGTSSSM[147]GSGVSDDVFSSSR (SEQ ID NO: 195) | 5 |
| | Oxi(M) | NHYNEEM[147]SNLR (SEQ ID NO: 196) | 95 |
| | Oxi(M) | NM[147]PLQHLLEQIK (SEQ ID NO: 197) | 33.33 |
| | Oxi(M) | NSQGSEM[147]FGDDDK (SEQ ID NO: 198) | 31.41 |
| | Oxi(M) | NSQGSEM[147]FGDDDKR (SEQ ID NO: 199) | 3.93 |
| | Oxi(M) | NSQGSEM[147]FGDDDKRK (SEQ ID NO: 200) | 1.96 |
| | Oxi(M) | QM[147]GQPCDAYQK (SEQ ID NO: 201) | 9.93 |
| | Oxi(M) | RGVITDQNSDGYC[407]QTGTM[147]SR (SEQ ID NO: 202) | 1 |
| | Oxi(M) | RGVITDQNSDGYC[432]QTGTM[147]SR (SEQ ID NO: 203) | 6 |
| | Oxi(M) | RGVITDQNSDGYCQTGTM[147]SR (SEQ ID NO: 204) | 10.96 |
| | Oxi(M) | RQDSLESM[147]K (SEQ ID NO: 205) | 2.98 |
| | Oxi(M) | SGSLSLTQFADM[147]ISLK (SEQ ID NO: 206) | 25.78 |
| | Oxi(M) | SLVSWHYCM[147]IDIEK (SEQ ID NO: 207) | 0.99 |
| | Oxi(M) | SM[147]VEDITGLR (SEQ ID NO: 208) | 34.53 |
| | Oxi(M) | SRELDEC[407]FAQANDQM[147]EILDSLIR (SEQ ID NO: 209) | 6 |
| | Oxi(M) | SRELDECFAQANDQM[147]EILDSLIR (SEQ ID NO: 210) | 2 |
| | Oxi(M) | SVQNDSQAIAEVLNQLKDM[147]LANFR (SEQ ID NO: 211) | 1.96 |
| | Oxi(M) | TM[147]IQSPSGVILQEAADVHAR (SEQ ID NO: 212) | 498.8 |
| | Oxi(M) | TTIHQLTM[147]QK (SEQ ID NO: 213) | 4 |
| | Oxi(M) | VRNHYNEEM[147]SNLR (SEQ ID NO: 214) | 6 |
| | Oxi(M) | VTAM[147]QLYECQLIDK (SEQ ID NO: 215) | 5.96 |
| | Phospho | GGGGY[243]T[181]CQ[129]S[167]GS[167]GWDEFT[181]K (SEQ ID NO: 216) | 1.98 |
| | Phospho | GGGGYTC[160]QS[167]GSGWDEFTK (SEQ ID NO: 217) | 2.97 |
| | Phospho | GGGGYTCQS[167]GSGWDEFTK (SEQ ID NO: 218) | 13 |
| | Phospho | GLPSPY[243]NMSSAPGS[167]R (SEQ ID NO: 219) | 1 |
| | Phospho | GLPSPYNMSS[167]APG5[167]R (SEQ ID NO: 220) | 19 |
| | Phospho | GLPSPYNMSSAPGS[167]R (SEQ ID NO: 221) | 3 |
| | Phospho | LPVEEAY[243]KR (SEQ ID NO: 222) | 7 |
| | Phospho | QET[181]WMLMELQK (SEQ ID NO: 223) | 2.94 |
| | Phospho | RGS[167]FDATGNSSYSYSYSFSSSSIGH (SEQ ID NO: 224) | 1 |
| | Phospho | RGSFDAT[181]GNSSYSYSYSFSSSSIGH (SEQ ID NO: 225) | 1 |
| | Phospho | RT[181]AS[167]EDS[167]CKR (SEQ ID NO: 226) | 1 |
| | Phospho | S[167]MSFQGI (SEQ ID NO: 227) | 7 |
| | Phospho | S[167]SSFSDTLEESSPIAAIFDTENLEK (SEQ ID NO: 228) | 37.99 |
| | Phospho | SMS[167]FQGIR (SEQ ID NO: 229) | 408.94 |
| | Phospho | SS[167]SFSDTLEESSPIAAIFDTENLEK (SEQ ID NO: 230) | 16 |
| | Phospho | SSS[167]FSDTLEESSPIAAIFDTENLEK (SEQ ID NO: 231) | 31.94 |
| | Phospho | SSSFS[167]DTLEESSPIAAIFDTENLEK (SEQ ID NO: 232) | 31 |
| | Phospho | SSSFSDT[181]LEESSPIAAIFDTENLEK (SEQ ID NO: 233) | 11 |
| | Phospho | SSSFSDTLEESS[167]PIAAIFDTENLEK (SEQ ID NO: 234) | 1 |
| | Phospho, Oxi(M) | GLPSPYNM[147]SSAPGS[167]R (SEQ ID NO: 235) | 0.99 |
| | Phospho, Oxi(M) | KVTAM[147]QLY[243]ECQLIDK (SEQ ID NO: 236) | 19 |
| | Phospho, Oxi(M) | SM[147]S[167]FQGIR (SEQ ID NO: 237) | 337.99 |
| | Phospho, Oxi(M) | VTAM[147]QLY[243]ECQLIDK (SEQ ID NO: 238) | 42 |
| ECM1 | Cit | DILTIDIGR[157] (SEQ ID NO: 7) | 0.99 |
| | Cit | FSCFQEEAPQPHYQLR[157] (SEQ ID NO: 239) | 1 |
| | Cit | LVWEEAMSR[157] (SEQ ID NO: 8) | 0.99 |

TABLE 6-continued

PTMs founds in Multiple Human Cohort

| Gene | Modification | modified_peptide | Sum of sc |
|---|---|---|---|
| | Cit | NLPATDPLQR[157] (SEQ ID NO: 9) | 0.99 |
| | Cit | QGETLNFLEIGYSR[157] (SEQ ID NO: 10) | 2.94 |
| | Cit | QHVVYGPWNLPQSSYSHLTR [157](SEQ ID NO: 11) | 2.94 |
| | Cit Phospho | Q[129]HVVYGPWN[115]LPQ[129]S[167]Y[243]S[167]HLT[181]R[157] (SEQ ID NO: 12) | 1.96 |
| | Oxi(M) | LVWEEAM[147]SR (SEQ ID NO: 240) | 774.6 |
| | Oxi(M) | SLPM[147]DHPDSSQHGPPFEGQ[129]SQVQPPPSQEATPLQQEK (SEQ ID NO: 241) | 2.97 |
| | Oxi(M) | SLPM[147]DHPDSSQHGPPFEGQSVQPPPSQEATPLQQEK (SEQ ID NO: 242) | 763.48 |
| | Oxi(M) | VTPNLM[147]GHLCGNQR (SEQ ID NO: 243) | 30.69 |
| | Phospho | LVWEEAMSRFCEAEFS[167]VKT[181]RPHWCCT[181]R (SEQ ID NO: 244) | 1 |
| EXTL2 | Cit | GIR[157]VLR[157]LSLVVILVLLLVAGALTALLPSVK (SEQ ID NO: 245) | 1 |
| | Cit | n[43]GIR[157]VLR[157]LSLVVILVLLLVAGALTALLPSVK (SEQ ID NO: 246) | 3 |
| | Cit | n[43]IR[157]VLR[157]LSLVVILVLLLVAGALTALLPSVK (SEQ ID NO: 247) | 5 |
| FAM136A | Oxi(M) | KM[147]KEALLSIGK (SEQ ID NO: 248) | 2 |
| | Oxi(M) | M[147]KEALLSIGK (SEQ ID NO: 249) | 4 |
| | Oxi(M) | M[147]QGLM[147]FR (SEQ ID NO: 250) | 3 |
| | Oxi(M) | M[147]QGLMFR (SEQ ID NO: 251) | 1 |
| | Oxi(M) | n[43]AELQQLRVQEAVESM[147]VK (SEQ ID NO: 252) | 11 |
| | Oxi(M) | VQEAVESM[147]VK (SEQ ID NO: 253) | 47.84 |
| GAPDH | Cit | AENGKLVINGNPITIFQER[157] (SEQ ID NO: 254) | 2 |
| | Cit | AENGKLVINGNPITIFQER[157]DPSK (SEQ ID NO: 255) | 13 |
| | Cit | LISWYDN[115]EFGYSN[115]R[157]VVDLMAHMASKE (SEQ ID NO: 256 | 5.94 |
| | Cit | LISWYDNEFGYSN[115]R[157]VVDLMAHMASKE (SEQ ID NO: 257) | 14.85 |
| | Cit | LISWYDNEFGYSNR[157] (SEQ ID NO: 258) | 14.88 |
| | Cit | LISWYDNEFGYSNR[157]VVDLMAHMASKE (SEQ ID NO: 259) | 9.9 |
| | Cit | LVIN[115]GN[115]PITIFQ[129]ER[157](SEQ ID NO: 260) | 0.98 |
| | Cit | LVIN[115]GNPITIFQ[129]ER[157]DPSK (SEQ ID NO: 261) | 1 |
| | Cit | LVIN[115]GNPITIFQER[157]DPSK (SEQ ID NO: 262) | 1.96 |
| | Cit | LVINGNPITIFQER[157] (SEQ ID NO: 263) | 172.61 |
| | Cit | LVINGNPITIFQER[157]DPSK (SEQ ID NO: 264) | 62.8 |
| | Cit | LVINGNPITIFQER[157]DPSKIK (SEQ ID NO: 265) | 3 |
| | Cit | LWR[157]DGR[157]GALQ[129]N[115]IIPASTGAAK (SEQ ID NO: 266) | 1.97 |
| | Cit | LWR[157]DGR[157]GALQ[129]NIIPASTGAAK (SEQ ID NO: 267) | 3.93 |
| | Cit | LWR[157]DGR[157]GALQNIIPASTGAAK (SEQ ID NO: 268) | 0.97 |
| | Cit | LWR[157]DGRGALQ[129]NIIPASTGAAK (SEQ ID NO: 269) | 3.93 |
| | Cit | LWR[157]DGRGALQNIIPASTGAAK (SEQ ID NO: 270) | 6.93 |
| | Cit | LWRDGR[157]GALQNIIPASTGAAK (SEQ ID NO: 271) | 16.72 |
| | Cit | R[157]VIISAPSADAPMFVMGVN[115]HEK (SEQ ID NO: 272) | 26.59 |
| | Cit | R[157]VIISAPSADAPMFVMGVNHEK (SEQ ID NO: 273) | 29.59 |
| | Cit | R[157]VIISAPSADAPMFVMGVNHEKYDNSLK (SEQ ID NO: 274) | 16.95 |
| | Cit | VGVN[115]GFGR[157] (SEQ ID NO: 275) | 3.98 |
| | Cit | VGVN[115]GFGR[157]IGR[157]LVTR (SEQ ID NO: 276) | 0.99 |
| | Cit | VGVNGFGR[157] (SEQ ID NO: 277) | 40.52 |
| | Cit | VIHDN[115]FGIVEGLMTTVHAITATQ[129]R[157] (SEQ ID NO: 278) | 1 |
| | Cit | VIHDNFGIVEGLMTTVHAITATQR[157] (SEQ ID NO: 279) | 12 |
| | Cit | VPTANVSVVDLTCR[157] (SEQ ID NO: 280) | 18.81 |
| | Cit | VPTANVSVVDLTCR[157]LEKPAK (SEQ ID NO: 281) | 7.92 |
| | Cit Oxi(M) | R[157]VIISAPSADAPM[147]FVM[147]GVN[115]HEK (SEQ ID NO: 282) | 0.99 |
| | Cit Oxi(M) | R[157]VIISAPSADAPM[147]FVM[147]GVNHEK (SEQ ID NO: 283) | 2.97 |
| | Cit Oxi(M) | R[157]VIISAPSADAPM[147]FVMGVNHEK (SEQ ID NO: 284) | 8.88 |
| | Cit Oxi(M) | R[157]VIISAPSADAPM[147]FVMGVNHEKYDNSLK (SEQ ID NO: 285) | 1 |
| | Cit Oxi(M) | R[157]VIISAPSADAPMFVM[147]GVN[115]HEK (SEQ ID NO: 286) | 11.81 |
| | Cit Oxi(M) | R[157]VIISAPSADAPMFVM[147]GVNHEK (SEQ ID NO: 287) | 2.99 |
| | Cit Phospho | LIS[167]WYDNEFGYSNR[157] (SEQ ID NO: 288) | 1.98 |
| | Oxi(M) | FGYSNRVVDLM[147]AHM[147]ASKE (SEQ ID NO: 289) | 1 |
| | Oxi(M) | GGAKRVIISAPSADAPM[147]FVM[147]GVNHE (SEQ ID NO: 290) | 0.99 |

TABLE 6-continued

PTMs founds in Multiple Human Cohort

| Gene | Modification | modified_peptide | Sum of sc |
|---|---|---|---|
| | Oxi(M) | GLM[147]TTVHAITATQKTVD (SEQ ID NO: 291) | 1 |
| | Oxi(M) | IKWGDAGAEYVVESTGVFTTM[147]EK (SEQ ID NO: 292) | 378.64 |
| | Oxi(M) | KAGAHLQGGAKRVIISAPSADAPM[147]FVM[147]GVNHE (SEQ ID NO: 293) | 0.99 |
| | Oxi(M) | LTGM[147]AFR (SEQ ID NO: 294) | 1244.15 |
| | Oxi(M) | LTGM[147]AFRVPTANVSVVDLTCR (SEQ ID NO: 295) | 118.51 |
| | Oxi(M) | LTGM[147]AFRVPTANVSVVDLTCRLEK (SEQ ID NO: 296) | 1.01 |
| | Oxi(M) | M[147]TTVHAITATQK (SEQ ID NO: 297) | 9.07 |
| | Oxi(M) | RVIISAPSADAPM[147]FVM[147]GVN[115]HEK (SEQ ID NO: 298) | 24.93 |
| | Oxi(M) | RVIISAPSADAPM[147]FVM[147]GVNHEK (SEQ ID NO: 299) | 759.1 |
| | Oxi(M) | RVIISAPSADAPM[147]FVM[147]GVNHEKYDNSLK (SEQ ID NO: 300) | 19.74 |
| | Oxi(M) | RVIISAPSADAPM[147]FVMGVN[115]HEK (SEQ ID NO: 301) | 7.86 |
| | Oxi(M) | RVIISAPSADAPM[147]FVMGVNHEK (SEQ ID NO: 302) | 277.55 |
| | Oxi(M) | RVIISAPSADAPM[147]FVMGVNHEKYDN[115]SLK (SEQ ID NO: 303) | 4.91 |
| | Oxi(M) | RVIISAPSADAPM[147]FVMGVNHEKYDNSLK (SEQ ID NO: 304) | 17.88 |
| | Oxi(M) | RVIISAPSADAPMFVM[147]GVN[115]HEK (SEQ ID NO: 305) | 17.7 |
| | Oxi(M) | RVIISAPSADAPMFVM[147]GVNHEK (SEQ ID NO: 306) | 501.29 |
| | Oxi(M) | RVIISAPSADAPMFVM[147]GVNHEKYDNSLK (SEQ ID NO: 307) | 3.98 |
| | Oxi(M) | VDIVAIN[115]DPFIDLN[115]YMVYM[147]FQYDSTHGK (SEQ ID NO: 308) | 1.99 |
| | Oxi(M) | VDIVAIN[115]DPFIDLNYM[147]VYMFQYDSTHGK (SEQ ID NO: 309) | 1 |
| | Oxi(M) | VDIVAINDPFIDLN (SEQ ID NO: 310) | 1 |
| | Oxi(M) | VDIVAINDPFIDLN[115]YMVYM[147]FQ[129]YDSTHGK (SEQ ID NO: 311) | 2 |
| | Oxi(M) | VDIVAINDPFIDLN (SEQ ID NO: 312) | 2 |
| | Oxi(M) | VDIVAINDPF1DLNYM[147]VYM[147]FQYDSTHGK (SEQ ID NO: 313) | 58.71 |
| | Oxi(M) | VIHDN[115]FGIVEGLM[147]TTVHAITATQ[129]K (SEQ ID NO: 314) | 19.68 |
| | Oxi(M) | VIHDN[115]FGIVEGLM[147]TTVHAITATQK (SEQ ID NO: 315) | 35.67 |
| | Oxi(M) | VIHDNFGIVEGLM[147] (SEQ ID NO: 316) | 1.92 |
| | Oxi(M) | VIHDNFGIVEGLM[147]TTVHAITATQ[129]K (SEQ ID NO: 317) | 52.51 |
| | Oxi(M) | VIHDNFGIVEGLM[147]TTVHAITATQK (SEQ ID NO: 317) | 4567.56 |
| | Oxi(M) | VIHDNFGIVEGLM[147]TTVHAITATQKTVDGPSGK (SEQ ID NO: 318) | 20 |
| | Oxi(M) | VIHDNFGIVEGLM[147]TTVHAITATQR (SEQ ID NO: 319) | 2 |
| | Oxi(M) | VIISAPSADAPM[147]FVM[147]GVN[115]HEK (SEQ ID NO: 320) | 45.74 |
| | Oxi(M) | VIISAPSADAPM[147]FVM[147]GVNHEK (SEQ ID NO: 321) | 1419.86 |
| | Oxi(M) | VIISAPSADAPM[147]FVMGVNHEK (SEQ ID NO: 322) | 509.69 |
| | Oxi(M) | VIISAPSADAPM[147]FVMGVNHEKYDNSLK (SEQ ID NO: 323) | 18.02 |
| | Oxi(M) | VIISAPSADAPMFVM[147]GVNHEK (SEQ ID NO: 324) | 582.42 |
| | Oxi(M) | VIPELN[115]GKLTGM[147]AFR (SEQ ID NO: 325) | 1.03 |
| | Oxi(M) | VIPELNGKLTGM[147]AFR (SEQ ID NO: 326) | 7.09 |
| | Oxi(M) | VVDLM[147]AHM[147]ASK (SEQ ID NO: 327) | 283.87 |
| | Oxi(M) | VVDLM[147]AHM[147]ASKE (SEQ ID NO: 328) | 851.35 |
| | Oxi(M) | VVDLM[147]AHMASK (SEQ ID NO: 329) | 97.35 |
| | Oxi(M) | VVDLM[147]AHMASKE (SEQ ID NO: 330) | 641.59 |
| | Oxi(M) | VVDLMAHM[147]ASK (SEQ ID NO: 331) | 200.78 |
| | Oxi(M) | VVDLMAHM[147]ASKE (SEQ ID NO: 332) | 993.17 |
| | Oxi(M) | W[202]GDAGAEYVVESTGVFTTM[147]EK (SEQ ID NO: 333) | 12 |
| | Oxi(M) | YM[147]FQYDSTHGK (SEQ ID NO: 334) | 3.12 |
| | Oxi(M) | YVVESTGVFTTM[147]EK (SEQ ID NO: 335) | 18.29 |
| | Phospho | VIHDNFGIVEGLMT[181]TVHAITATQK (SEQ ID NO: 336) | 53.65 |
| | Phospho | VIHDNFGIVEGLMTTVHAITAT[181]QK (SEQ ID NO: 337) | 815.14 |
| | Phospho | VIIS[167]APSADAPMFVMGVNHEK (SEQ ID NO: 338) | 0.99 |
| | Phospho | VPT[181]ANVSVVDLTCR (SEQ ID NO: 339) | 2.98 |
| | Phospho, Oxi(M) | VIHDNFGIVEGLM[147]TTVHAIT[181]ATQK (SEQ ID NO: 340) | 0.99 |
| | Phospho, Oxi(M) | VIHDNFGIVEGLM[147]TTVHAITAT[181]QK (SEQ ID NO: 341) | 92.48 |
| H2AFZ | Phospho | AT[181]IAGGGVIPHIHK (SEQ ID NO: 342) | 2 |
| | Phospho | VGATAAVYSAAILEYLTAEVLELAGNAS[167]K (SEQ ID NO: 343) | 2.97 |
| HIST1 H1B | Cit | ER[157]N[115]GLSLAALK (SEQ ID NO: 344) | 15 |
| | Cit | ER[157]NGLSLAALK (SEQ ID NO: 345) | 12 |
| | Cit | ER[157]NGLSLAALKK (SEQ ID NO: 346) | 5 |
| | Phospho | KAT[181]GPPVSELITK (SEQ ID NO: 347) | 21 |
| | Phospho | n[43]S[167]ETAPAETATPAPVEK (SEQ ID NO: 348) | 2 |
| | Phospho | n[43]SETAPAET[181]ATPAPVEK (SEQ ID NO: 349) | 1 |
| | Phospho | n[43]SETAPAETAT[181]PAPVEK (SEQ ID NO: 1236) | 2 |

TABLE 6-continued

PTMs founds in Multiple Human Cohort

| Gene | Modification | modified_peptide | Sum of sc |
|---|---|---|---|
| | Phospho | n[43]SETAPAETAT[181]PAPVEKS[167]PAK (SEQ ID NO: 1237) | 1 |
| | Phospho | n[43]SETAPAETATPAPVEKS[167]PAK (SEQ ID NO: 1238) | 126 |
| | Phospho | S[167]ETAPAETATPAPVEK (SEQ ID NO: 1239) | 1 |
| | Phospho | SETAPAET[181]ATPAPVEKSPAK (SEQ ID NO: 1240) | 5 |
| | Phospho | SETAPAET[181]ATPAPVEKSPAKK (SEQ ID NO: 1241) | 1 |
| | Phospho | SETAPAETATPAPVEKS[167]PAK (SEQ ID NO: 1242) | 12 |
| HIST1 ME | Cit | ALAAAGYDVEKNNSR[157] (SEQ ID NO: 1243) | 22 |
| | Cit | E[111]R[157]SGVSLAALK (SEQ ID NO: 1244) | 9 |
| | Cit | ER[157]SGVSLAALK (SEQ ID NO: 1245) | 36.03 |
| | Cit | ER[157]SGVSLAALKK (SEQ ID NO: 350) | 6.03 |
| | Phospho | AS[167]GPPVSELITK (SEQ ID NO: 351) | 2.98 |
| | Phospho | KAPKS[167]PAK (SEQ ID NO: 352) | 1 |
| | Phospho | KAS[167]GPPVSELITK (SEQ ID NO: 353) | 258.15 |
| | Phospho | n[43]S[167]ETAPAAPAAPAPAEK (SEQ ID NO: 354) | 2 |
| | Phospho | n[43]S[167]ETAPAAPAAPAPAEKT[181]PVK (SEQ ID NO: 355) | 35 |
| | Phospho | n[43]S[167]ETAPAAPAAPAPAEKT[181]PVKK (SEQ ID NO: 356) | 1 |
| | Phospho | n[43]S[167]ETAPAAPAAPAPAEKTPVK (SEQ ID NO: 357) | 1 |
| | Phospho | n[43]S[167]ETAPAAPAAPAPAEKTPVKKK (SEQ ID NO: 358) | 1 |
| | Phospho | n[43]SET[181]APAAPAAPAPAEKT[181]PVK (SEQ ID NO: 359) | 8 |
| | Phospho | n[43]SETAPAAPAAPAPAEKT[181]PVK (SEQ ID NO: 360) | 264 |
| | Phospho | n[43]SETAPAAPAAPAPAEKT[181]PVKK (SEQ ID NO: 361) | 217 |
| | Phospho | n[43]SETAPAAPAAPAPAEKT[181]PVKKK (SEQ ID NO: 362) | 4 |
| | Phospho | n[43]SETAPAAPAAPAPAEKT[181]PVKKKAR (SEQ ID NO: 363) | 2 |
| | Phospho | n[43]SETAPAAPAAPAPAEKT[181]PVKKKARK (SEQ ID NO: 364) | 1 |
| | Phospho | RKAS[167]GPPVSELITK (SEQ ID NO: 365) | 11.01 |
| | Phospho | S[167]ETAPAAPAAPAPAEK (SEQ ID NO: 366) | 9 |
| | Phospho | S[167]ETAPAAPAAPAPAEKTPVKK (SEQ ID NO: 367) | 1 |
| | Phospho | S[167]GVSLAALK (SEQ ID NO: 368) | 9.96 |
| | Phospho | SETAPAAPAAPAPAEKT[181]PVK (SEQ ID NO: 369) | 18 |
| | Phospho | SLVSKGT[181]LVQTKGT[181]GAS[167]GSFK (SEQ ID NO: 370) | 1 |
| HIST1 H4A | Cit | DNIQGITKPAIR[157] (SEQ ID NO: 371) | 7 |
| | Cit | ISGLIYEETR[157] (SEQ ID NO: 372) | 3 |
| | Cit | KTVTAMDVVYALKR[157] (SEQ ID NO: 373) | 3 |
| | Cit | R[157]ISGLIYEETRGVLK (SEQ ID NO: 374) | 29 |
| | Cit | RISGLIYEETR[157]GVLK (SEQ ID NO: 375) | 46 |
| | Cit | TVTAMDVVYALKR[157] (SEQ ID NO: 376) | 9 |
| | Cit | VFLEN[115]VIR[157]DAVTYTEHAK (SEQ ID NO: 377) | 15 |
| | Cit | VFLENVIR[157] (SEQ ID NO: 378) | 7 |
| | Cit | VFLENVIR[157]DAVTYTEHAK (SEQ ID NO: 379) | 23 |
| | Cit Oxi(M) | TVTAM[147]DVVYALKR[157] (SEQ ID NO: 380) | 3 |
| | Oxi(M) | KTVTAM[147]DVVYALK (SEQ ID NO: 381) | 802 |
| | Oxi(M) | KTVTAM[147]DVVYALKR (SEQ ID NO: 382) | 186 |
| | Oxi(M) | KTVTAM[147]DVVYALKRQGR (SEQ ID NO: 383) | 1 |
| | Oxi(M) | n[44]K[171]TVTAM[147]DVVYALK (SEQ ID NO: 384) | 1 |
| | Oxi(M) | n[44]TVTAM[147]DVVYALK (SEQ ID NO: 385) | 1 |
| | Oxi(M) | RK[185]TVTAM[147]DVVYALK (SEQ ID NO: 386) | 2 |
| | Oxi(M) | RKTVTAM[147]DVVYALK (SEQ ID NO: 387) | 39 |
| | Oxi(M) | RKTVTAM[147]DVVYALKR (SEQ ID NO: 388) | 22 |
| | Oxi(M) | TVTAM[147]DVVYALK (SEQ ID NO: 389) | 6417.82 |
| | Oxi(M) | TVTAM[147]DVVYALK[171]R (SEQ ID NO: 390) | 4 |
| | Oxi(M) | TVTAM[147]DVVYALKR (SEQ ID NO: 391) | 2130 |
| | Oxi(M) | TVTAM[147]DVVYALKRQGR (SEQ ID NO: 392) | 19 |
| | Phospho | DNIQGIT[181]KPAIR (SEQ ID NO: 393) | 1 |
| | Phospho | KT[181]VT[181]AMDVVY[243]ALK (SEQ ID NO: 394) | 14 |
| | Phospho | KTVTAMDVVY[243]ALK (SEQ ID NO: 395) | 3 |
| | Phospho | KTVTAMDVVY[243]ALKR (SEQ ID NO: 396) | 46 |
| | Phospho | R[166]IS[167]GLIYEETR[166] (SEQ ID NO: 397) | 1 |
| | Phospho | RIS[167]GLIYEETR (SEQ ID NO: 398) | 155.95 |
| | Phospho | T[181]VT[181]AMDVVYALKR (SEQ ID NO: 399) | 1 |
| | Phospho | T[181]VTAMDVVYALK (SEQ ID NO: 400) | 9 |
| | Phospho | TVTAMDVVY[243]ALK (SEQ ID NO: 401) | 30 |
| | Phospho | TVTAMDVVY[243]ALKR (SEQ ID NO: 402) | 64 |
| | Phospho, Oxi(M) | KTVTAM[147]DVVY[243]ALK (SEQ ID NO: 403) | 102 |
| | Phospho, Oxi(M) | KTVTAM[147]DVVY[243]ALKR (SEQ ID NO: 404) | 133 |
| | Phospho, Oxi(M) | TVTAM[147]DVVY[243]ALK (SEQ ID NO: 405) | 188 |
| | Phospho, Oxi(M) | TVTAM[147]DVVY[243]ALKR (SEQ ID NO: 406) | 159 |

TABLE 6-continued

PTMs founds in Multiple Human Cohort

| Gene | Modification | modified_peptide | Sum of sc |
|---|---|---|---|
| HLA-A | Cit | APWIEQEGPEYWDGETR[157] (SEQ ID NO: 407) | 9.96 |
| | Cit | APWIEQEGPEYWDLQTR[157] (SEQ ID NO: 408) | 2.97 |
| | Cit | APWIEQEGPEYWDQETR[157] (SEQ ID NO: 409) | 13.32 |
| | Cit | APWIEQEGPEYWDR[157] (SEQ ID NO: 410) | 4.85 |
| | Cit | APWIEQERPEYWDQETR[157] (SEQ ID NO: 411) | 1 |
| | Cit | AYLEGTCVEWLR[157] (SEQ ID NO: 412) | 2.89 |
| | Cit | CWALGFYPAEITLTWQR[157] (SEQ ID NO: 413) | 7.62 |
| | Cit | DGEDQTQDTELVETR[157]PAGDGTFQK (SEQ ID NO: 414) | 34.42 |
| | Cit | FIAVGYVDDTQ[129]FVR[157] (SEQ ID NO: 415) | 16.86 |
| | Cit | FIAVGYVDDTQFVR[157] (SEQ ID NO: 416) | 5.54 |
| | Cit | GYQQDAYDGKDYIALNEDLR[157] (SEQ ID NO: 417) | 1.03 |
| | Cit | THMTHHAVSDHEATLR[157] (SEQ ID NO: 418) | 5.24 |
| | Cit | WAAVVVPSGEEQR[157] (SEQ ID NO: 419) | 9.05 |
| | Cit | WAAVVVPSGQEQR[157] (SEQ ID NO: 420) | 6.07 |
| | Cit | WASVVVPSGQEQR[157] (SEQ ID NO: 421) | 2.96 |
| | Cit | WEPSSQPTIPIVGIIAGLVLFGAVITGAVVAAVMWR[157]RK (SEQ ID NO: 422) | 1.01 |
| | Cit | YLENGKETLQR[157] (SEQ ID NO: 423) | 21.25 |
| | Oxi(M) | M[147]YGCDVGPDGR (SEQ ID NO: 424) | 11.47 |
| | Oxi(M) | M[147]YGCDVGSDWR (SEQ ID NO: 425) | 2.02 |
| | Oxi(M) | SWTAADM[147]AAQIIK (SEQ ID NO: 426) | 26.18 |
| | Oxi(M) | SWTAADM[147]AAQITQR (SEQ ID NO: 427) | 13.14 |
| | Oxi(M) | SWTAADM[147]AAQTIK (SEQ ID NO: 428) | 16.94 |
| | Oxi(M) | THM[147]THHAVSDHEATLR (SEQ ID NO: 429) | 38.1 |
| | Oxi(M) | THM[147]THHPISDHEATLR (SEQ ID NO: 430) | 45.08 |
| | Oxi(M) | YYNQSEDGSHTIQM[147]M[147]YGCDVGSDGR (SEQ ID NO: 431) | 4 |
| | Phospho | E[111]TLQRT[181]DAPK (SEQ ID NO: 432) | 1 |
| | Phospho | MY[243]GCDVGPDR (SEQ ID NO: 433) | 1 |
| | Phospho | n[43]Y[243]GCDVGS[167]DGR (SEQ ID NO: 434) | 3 |
| | Phospho | n[44]RY[243]LENGKK (SEQ ID NO: 435) | 5.08 |
| | Phospho | RYLENGKET[181]LQR (SEQ ID NO: 436) | 154.1 |
| | Phospho, Oxi(M) | AVM[147]APRTLLLLLSGALALTQT[181]WAGS[167]HSMR (SEQ ID NO: 437) | 1 |
| | Phospho, Oxi(M) | M[147]Y[243]GCDVGSDWR (SEQ ID NO: 438) | 2 |
| | Phospho, Oxi(M) | TLLLLLLSGALALTHTWAGS[167]HSM[147]R (SEQ ID NO: 439) | 2 |
| ICAM1 | Cit | EPAVGEPAEVTTTVLVR[157] (SEQ ID NO: 440) | 3 |
| | Cit | TFLTVYWTPER[157] (SEQ ID NO: 441) | 1 |
| | Cit | TFLTVYWTPER[157]VELAPLPSWQPVGK (SEQ ID NO: 442) | 1 |
| | Cit | VTLNGVPAQPLGPR[157] (SEQ ID NO:443) | 1 |
| | Oxi(M) | GTPM[147]KPNTQATPP (SEQ ID NO: 444) | 10.94 |
| | Phospho | DCPGNWT[181]WPENS[167]QQT[181]PMCQAWGNPLPELKCLK (SEQ ID NO: 445) | 1 |
| | Phospho | GGS[167]VLVTCSTSCDQPK (SEQ ID NO: 446) | 0.99 |
| IGFBP1 | Oxi(M) | SAGCGCCPM[147]CALPLGAACGVATAR (SEQ ID NO: 447) | 153 |
| | Phospho | AQETS[167]GEEI5K (SEQ ID NO: 448) | 85 |
| | Phospho, Oxi(M) | KWKCET[181]S[167]M[147]DGEAGLCWCVY[243]PWNGKR (SEQ ID NO: 449) | 2 |
| IGHG2 | Cit | ASTKGPSVFPLAPCSR[157]STSESTAALGCLVK (SEQ ID NO: 450) | 2 |
| | Cit | DTLMISR[157] (SEQ ID NO: 451) | 5.96 |
| | Cit | DTLMISR[157]TPEVTCVVVDVSHED (SEQ ID NO: 452) | 2.98 |
| | Cit | DTLMISR[157]TPEVTCVVVDVSHEDPEVQ[129]FN[115]WYVDGVEVHN[115]AK (SEQ ID NO: 453) | 9 |
| | Cit | DTLMISR[157]TPEVTCVVVDVSHEDPEVQ[129]FN[115]WYVDGVEVHNAK (SEQ ID NO: 454) | 5 |
| | Cit | DTLMISR[157]TPEVTCVVVDVSHEDPEVQFN[115]WYVDGVEVHNAK (SEQ ID NO: 455) | 12 |
| | Cit | DTLMISR[157]TPEVTCVVVDVSHEDPEVQFNWYVDGVEVHNAK (SEQ ID NO: 456) | 1 |
| | Cit | GPSVFPLAPCSR[157]STSESTAALGCLVK (SEQ ID NO: 457) | 4 |
| | Cit | GQ[129]PREPQVYTLPPSR[157]EEMTK (SEQ ID NO: 458) | 4.96 |
| | Cit | GQPR[157]EPQ[129]VYTLPPSR[157]EEMTK (SEQ ID NO: 459) | 5.96 |
| | Cit | GQPR[157]EPQVYTLPPSR[157]EEMTK (SEQ ID NO: 460) | 6.96 |
| | Cit | GQPR[157]EPQVYTLPPSREEMTK (SEQ ID NO: 461) | 24.84 |
| | Cit | GQPR[157]EPQVYTLPPSREEMTKNQVSLTCLVK (SEQ ID NO: 462) | 2.98 |
| | Cit | GQPREPQ[129]VYTLPPSR[157]EEMTK (SEQ ID NO: 463) | 7.94 |
| | Cit | GQPREPQ[129]VYTLPPSR[157]EEMTKNQVSLTCLVK (SEQ ID NO: 464) | 5.96 |
| | Cit | GQPREPQVYTLPPSR[157]EEMTK (SEQ ID NO: 465) | 6.95 |
| | Cit | SR[157]WQ[129]QGNVFSCSVMHEALHNHYTQK (SEQ ID NO: 466) | 4.97 |

TABLE 6-continued

PTMs founds in Multiple Human Cohort

| Gene | Modification | modified_peptide | Sum of sc |
|---|---|---|---|
| | Cit | SR[157]WQQGNVFSCSVMHEALHNHYTQ[129]K (SEQ ID NO: 467) | 1 |
| | Cit | SR[157]WQQGNVFSCSVMHEALHNHYTQK (SEQ ID NO: 468) | 1 |
| | Cit Oxi(M) | DTLM[147]ISR[157]TPEVTCVVVDVSHEDPEVQFNWYVDGVEVHN AK (SEQ ID NO: 469) | 1 |
| | Cit Oxi(M) | GQ[129]PREPQVYTLPPSR[157]EEM[147]TK (SEQ ID NO: 470) | 4.97 |
| | Cit Oxi(M) | GQ[129]PREPQVYTLPPSR[157]EEM[147]TKNQ[129]VSLTCLVK (SEQ ID NO: 471) | 2.98 |
| | Cit Oxi(M) | GQPR[157]EPQVYTLPPSREEM[147]TK (SEQ ID NO: 472) | 5.97 |
| | Cit Oxi(M) | GQPR[157]EPQVYTLPPSREEM[147]TKNQVSLTCLVK (SEQ ID NO: 473) | 2.98 |
| | Cit Oxi(M) | GQPREPQ[129]VYTLPPSR[157]EEM[147]TK (SEQ ID NO: 474) | 5.97 |
| | Cit Oxi(M) | GQPREPQVYTLPPSR[157]EEM[147]TK (SEQ ID NO: 475) | 13.91 |
| | Cit Oxi(M) | GQPREPQVYTLPPSR[157]EEM[147]TKN[115]Q[129]VSLTCLVK (SEQ ID NO: 476) | 1 |
| | Cit Oxi(M) | GQPREPQVYTLPPSR[157]EEM[147]TKNQ[129]VSLTCLVK (SEQ ID NO: 477) | 5.96 |
| | Cit Oxi(M) | SR[157]WQQGN[115]VFSCSVM[147]HEALHNHYTQ[129]K (SEQ ID NO: 478) | 3.97 |
| | Cit Oxi(M) | SR[157]WQQGNVFSCSVM[147]HEALHNHYTQK (SEQ ID NO: 479) | 4.97 |
| | Oxi(M) | DTLM[147]ISR (SEQ ID NO: 480) | 6907.69 |
| | Oxi(M) | E[111]PQVYTLPPSREEM[147]TK (SEQ ID NO: 481) | 1 |
| | Oxi(M) | EPQ[129]VYTLPPSREEM[147]TK (SEQ ID NO: 482) | 1 |
| | Oxi(M) | EPQVYTLPPSREEM[147]TK (SEQ ID NO: 483) | 100.51 |
| | Oxi(M) | GQ[129]PREPQVYTLPPSREEM[147]TKNQ[129]VSLTCLVK (SEQ ID NO: 484) | 3.98 |
| | Oxi(M) | GQPREPQ[129]VYTLPPSREEM[147]TK (SEQ ID NO: 485) | 15.89 |
| | Oxi(M) | GQPREPQ[129]VYTLPPSREEM[147]TKNQVSLTCLVK (SEQ ID NO: 486) | 8.94 |
| | Oxi(M) | GQPREPQVYTLPPSREEM[147]TK (SEQ ID NO: 487) | 159.47 |
| | Oxi(M) | GQPREPQVYTLPPSREEM[147]TKN[115]Q[129]VSLTCLVK (SEQ ID NO: 488) | 1 |
| | Oxi(M) | GQPREPQVYTLPPSREEM[147]TKNQ[129]VSLTCLVK (SEQ ID NO: 489) | 1 |
| | Oxi(M) | GQPREPQVYTLPPSREEM[147]TKNQVSLTCLVK (SEQ ID NO: 490) | 28.86 |
| | Oxi(M) | SRWQ[129]QGNVFSCSVM[147]HEALHN[115]HYTQK (SEQ ID NO: 491) | 1 |
| | Oxi(M) | SRWQ[129]QGNVFSCSVM[147]HEALHNHYTQ[129]K (SEQ ID NO: 492) | 1 |
| | Oxi(M) | SRWQ[129]QGNVFSCSVM[147]HEALHNHYTQK (SEQ ID NO: 493) | 10.97 |
| | Oxi(M) | SRWQQ[129]GN[115]VFSCSVM[147]HEALHNHYTQK (SEQ ID NO: 494) | 4.97 |
| | Oxi(M) | SRWQQ[129]GNVFSCSVM[147]HEALHN[115]HYTQK (SEQ ID NO: 495) | 4.97 |
| | Oxi(M) | SRWQQ[129]GNVFSCSVM[147]HEALHNHYTQK (SEQ ID NO: 496) | 7.95 |
| | Oxi(M) | SRWQQGN[115]VFSCSVM[147]HEALHN[115]HYTQK (SEQ ID NO: 497) | 3.97 |
| | Oxi(M) | SRWQQGN[115]VFSCSVM[147]HEALHNHYTQK (SEQ ID NO: 498) | 5.97 |
| | Oxi(M) | SRWQQGNVFSCSVM[147]HEALHN[115]HYTQ[129]K (SEQ ID NO: 499) | 4.97 |
| | Oxi(M) | SRWQQGNVFSCSVM[147]HEALHN[115]HYTQK (SEQ ID NO: 500) | 1 |
| | Oxi(M) | SRWQQGNVFSCSVM[147]HEALHNHYTQK (SEQ ID NO: 501) | 35.88 |
| | Oxi(M) | TTPPM[147]LDSDGSFFLYSK (SEQ ID NO: 502) | 3150.16 |
| | Oxi(M) | WQQGNVFSCSVM[147]HEALHNHYTQK (SEQ ID NO: 503) | 129.57 |
| IL2 | Oxi(M) | QM[147]ILN[115]GINNYK (SEQ ID NO: 504) | 5.97 |
| | Oxi(M) | QM[147]ILNGIN[115]NYK (SEQ ID NO: 505) | 20.91 |
| | Oxi(M) | QM[147]ILNGINN[115]YK (SEQ ID NO: 506) | 6.98 |
| | Oxi(M) | QM[147]ILNGINNYK (SEQ ID NO: 507) | 24.9 |
| LCN2 | Cit | CDYWIR[157]TFVPGCQPGEFTLGNIK (SEQ ID NO: 508) | 7.03 |
| | Cit | WYVGLAGN[115]AILR[157]EDK (SEQ ID NO: 509) | 9.01 |
| | Cit | WYVGLAGNAILR | 6 |
| | Oxi(M) | M[147]YATIYELK (SEQ ID NO: 511) | 262 |
| | Oxi(M) | M[147]YATIYELKEDK (SEQ ID NO: 512) | 53.08 |
| | Oxi(M) | VVSTNYNQHAM[147]VFFK (SEQ ID NO: 513) | 11 |
| LTF | Cit | C[143]VPNSNERYYGYTGAFR[157]CLAEN[115]AGDVAFVK (SEQ ID NO: 514) | 2 |
| | Cit | C[143]VPNSNERYYGYTGAFR[157]CLAENAGDVAFVK (SEQ ID NO: 515) | 5.97 |

TABLE 6-continued

PTMs founds in Multiple Human Cohort

| Gene | Modification | modified_peptide | Sum of sc |
|---|---|---|---|
| | Cit | CVPN[115]SNERYYGYTGAFR[157]CLAENAGDVAFVK (SEQ ID NO: 516) | 4.99 |
| | Cit | CVPNSNER[157]YYGYTGAFR[157]CLAENAGDVAFVK (SEQ ID NO: 517) | 1 |
| | Cit | CVPNSNER[157]YYGYTGAFRCLAENAGDVAFVK (SEQ ID NO: 518) | 1 |
| | Cit | CVPN SNERYYGYTGAFR (SEQ ID NO: 519) | 4.98 |
| | Cit | CVPNSNERYYGYTGAFR[157]CLAENAGDVAFVK (SEQ ID NO: 520) | 4.99 |
| | Cit | DCHLARVPSHAVVAR[157]SVNGKEDAIWN (SEQ ID NO: 521) | 3.99 |
| | Cit | DCHLARVPSHAVVARSVNGKEDAIWNLLR[157]QAQEK (SEQ ID NO: 522) | 3.99 |
| | Cit | DSAIGFSR[157]VPPRIDSGLYLGSGYFTAIQ[129]NLRK (SEQ ID NO: 523) | 3.97 |
| | Cit | DSAIGFSR[157]VPPRIDSGLYLGSGYFTAIQNLRK (SEQ ID NO: 524) | 7.94 |
| | Cit | DSAIGFSRVPPR[157]IDSGLYLGSGYFTAIQ[129]NLRK (SEQ ID NO: 525) | 3.97 |
| | Cit | DSAIGFSRVPPR[157]IDSGLYLGSGYFTAIQN[115]LRK (SEQ ID NO: 526) | 3.97 |
| | Cit | DSAIGFSRVPPR[157]IDSGLYLGSGYFTAIQNLR[157]K (SEQ ID NO: 527) | 7.94 |
| | Cit | DSAIGFSRVPPR[157]IDSGLYLGSGYFTAIQNLRK (SEQ ID NO: 528) | 4.97 |
| | Cit | DSAIGFSRVPPRIDSGLYLGSGYFTAIQNLR[157]K (SEQ ID NO: 529) | 8.94 |
| | Cit | ESTVFEDLSDEAER[157]DEYELLCPDNTR (SEQ ID NO: 530) | 9.05 |
| | Cit | FDEYFSQSCAPGSDPR[157]SNLCALCIGDEQGENK (SEQ ID NO: 531) | 1 |
| | Cit | FGR[157]N[115]GSDCPDK (SEQ ID NO: 532) | 1 |
| | Cit | FGR[157]NGSDCPDK (SEQ ID NO: 533) | 10.98 |
| | Cit | IDSGLYLGSGYFTAIQNLR | 17.89 |
| | Cit | LRPVAAEVYGTER | 3 |
| | Cit | NLLFNDNTECLAR[157] (SEQ ID NO: 535) | 1.96 |
| | Cit | NLLFNDNTECLAR[157]LHGK (SEQ ID NO: 536) | 4.99 |
| | Cit | R[157]SDTSLTWNSVK (SEQ ID NO: 537) | 9.05 |
| | Cit | RKPVTEAR[157]SCHLAMAPNHAVVSRMDK (SEQ ID NO: 538) | 1.99 |
| | Cit | SQQSSDPDPNCVDR[157]PVEGYLAVAVVR (SEQ ID NO: 539) | 18.09 |
| | Cit | SQQSSDPDPNCVDR[157]PVEGYLAVAVVR | 6.02 |
| | Cit | SQQSSDPDPNCVDRPVEGYLAVAVVR | 3.02 |
| | Cit | VPPR[157]IDSGLYLGSGYFTAIQNLR (SEQ ID NO: 542) | 3.02 |
| | Cit | VPSHAVVAR[157] (SEQ ID NO: 14) | 5.92 |
| | Cit | VR[157]GPPVSQK (SEQ ID NO: 543) | 0.99 |
| | Cit | VVWCAVGEQELR[157] (SEQ ID NO: 544) | 3.02 |
| | Cit | VVWCAVGEQELR[157]K (SEQ ID NO: 545) | 6.04 |
| | Oxi(M) | GEADAM[147]SLDGGYVYTAGK (SEQ ID NO: 546) | 133.15 |
| | Oxi(M) | RKPVTEARSCHLAM[147]APNHAVVSRM[147]DK (SEQ ID NO: 547) | 3 |
| | Oxi(M) | RKPVTEARSCHLAM[147]APNHAVVSRMDK (SEQ ID NO: 548) | 2 |
| | Oxi(M) | RKPVTEARSCHLAMAPNHAVVSRM[147]DK (SEQ ID NO: 549) | 4 |
| | Oxi(M) | SCHLAM[147]APNHAVVSR (SEQ ID NO: 550) | 97.17 |
| | Phospho | S[167]DT[181]S[167]LT[181]W[202]N[115]S[167]VK (SEQ ID NO: 15) | 6 |
| | Phospho | T[181]AGWN[115]IPMGLLFN[115]Q[129]TGSCK (SEQ ID NO: 551) | 1 |
| | Phospho | YY[243]GYTGAFR (SEQ ID NO: 552) | 13.93 |
| LUM | Cit | FN[115]ALQ[129]YLR[157] (SEQ ID NO: 16) | 10 |
| | Cit | FNALQYLR[157] (SEQ ID NO: 17) | 1 |
| | Cit | GLKSLEYLDLSFNQIAR[157] (SEQ ID NO: 553) | 1 |
| | Cit | LPSGLPVSLLTLYLDNNKISNIPDEYFKR[157] (SEQ ID NO: 554) | 8 |
| | Cit | SLEYLDLSFNQIAR[157] (SEQ ID NO: 18) | 28 |
| | Oxi(M) | ISETSLPPDM[147]YECLR (SEQ ID NO: 555) | 694 |
| | Oxi(M) | SVPM[147]VPPGIK (SEQ ID NO: 556) | 465 |
| | Phospho | FNALQY[243]LR (SEQ ID NO: 557) | 2 |
| | Phospho | LDLSY[243]NK (SEQ ID NO: 558) | 1.96 |
| | Phospho | VANEVT[181]LN (SEQ ID NO: 559) | 6 |
| MATN2 | Cit | GICEALEDSDGR[157]Q[129]DSPAGELPK (SEQ ID NO: 560) | 3 |
| | Cit | GICEALEDSDGR[157]QDSPAGELPK (SEQ ID NO: 561) | 4 |
| | Cit | KGICEALEDSDGR[157]QDSPAGELPK (SEQ ID NO: 562) | 11 |
| | Oxi(M) | C[143]ENLIM[147]FQNLANEEVRK (SEQ ID NO: 563) | 5 |
| | Oxi(M) | TC[160]SRVDYC[160]LLSDHGC[160]EYSC[160]VNM[147]DR (SEQ ID NO: 564) | 2 |
| | Oxi(M) | TCSRVDYCLLSDHGCEYSCVNM[147]DR (SEQ ID NO: 565) | 2 |
| | Oxi(M) | VIM[147]IVTDGRPQDSVAEVAAK (SEQ ID NO: 566) | 8 |
| | Phospho | KLCTAHMCSTLEHNCAHFCINIPGS[167]Y[243]VCRCK (SEQ ID NO: 567) | 1 |
| | Phospho | RINYCALNKPGCEHECVNMEES[167]Y[243]Y[243]CR (SEQ ID NO: 568) | 1 |

TABLE 6-continued

PTMs founds in Multiple Human Cohort

| Gene | Modification | modified_peptide | Sum of sc |
|---|---|---|---|
| MB | Cit | VEADIPGHGQEVLIR[157] (SEQ ID NO: 569) | 0.98 |
| | Cit | VEADIPGHGQEVLIR[157]LFK (SEQ ID NO: 570) | 2.94 |
| | Oxi(M) | ALELFRKDM[147]ASNYKELGFQG (SEQ ID NO: 571) | 1 |
| | Oxi(M) | DM[147]ASNYK (SEQ ID NO: 572) | 10 |
| | Oxi(M) | DM[147]ASNYKELGFQG (SEQ ID NO: 573) | 193 |
| | Oxi(M) | FKHLKSEDEM[147]K (SEQ ID NO: 574)) | 22.77 |
| | Oxi(M) | HLKSEDEM[147]K (SEQ ID NO: 575) | 1.98 |
| | Oxi(M) | HLKSEDEM[147]KASEDLK (SEQ ID NO: 576) | 16.87 |
| | Oxi(M) | HPGDFGADAQGAM[147]NK (SEQ ID NO: 577) | 829.33 |
| | Oxi(M) | KDM[147]ASNYK (SEQ ID NO: 578) | 3 |
| | Oxi(M) | KDM[147]ASNYKELGFQG (SEQ ID NO: 579) | 64 |
| | Oxi(M) | M[147]KASEDLKK (SEQ ID NO: 580) | 1 |
| | Oxi(M) | SEDEM[147]KASEDLK (SEQ ID NO: 581) | 50.53 |
| | Oxi(M) | SEDEM[147]KASEDLKK (SEQ ID NO: 582) | 140.68 |
| | Phospho | YLEFIS[167]ECIIQVLQSK (SEQ ID NO: 583) | 0.99 |
| | Phospho | YLEFISECIIQVLQS[167]K (SEQ ID NO: 584) | 2.97 |
| MMP9 | Cit | EYSTCTSEGR[157]GDGRLWCATTSN[115]FDSDK (SEQ ID NO: 585) | 2 |
| | Cit | FGNADGAACHFPFIFEGR[157] (SEQ ID NO: 586) | 3 |
| | Cit | GSR[157]PQGPFLIADKWPALPR (SEQ ID NO: 587) | 3 |
| | Cit | LFGFCPTR[157]ADSTVMGGNSAGELCVFPFTFLGK (SEQ ID NO: 588) | 8 |
| | Cit | LGLGADVAQVTGALR[157]SGRGK (SEQ ID NO: 589) | 1 |
| | Cit | LGLGADVAQVTGALRSGR[157]GK (SEQ ID NO: 590) | 1 |
| | Oxi(M) | M[147]LLFSGR (SEQ ID NO: 591) | 1 |
| MPO | Cit | FCGLPQPETVGQLGTVLR[157] (SEQ ID NO: 592) | 15 |
| | Cit | FPTDQLTPDQER[157] (SEQ ID NO: 593) | 24 |
| | Cit | GRVGPLLACIIGTQFR[157]1( (SEQ ID NO: 594) | 4 |
| | Cit | IANVFTNAFR[157] (SEQ ID NO: 595) | 4 |
| | Cit | IPCFLAGDTR[157] (SEQ ID NO: 596) | 3 |
| | Cit | N[115]QINALTSFVDASMVYGSEEPLAR[157] (SEQ ID NO: 597) | 2 |
| | Cit | VGPLLACIIGTQFR[157] (SEQ ID NO: 598) | 6 |
| | Cit Oxi(M) | DGDR[157]WWWENEGVFSM[147]QQR (SEQ ID NO: 600) | 3 |
| | Cit Oxi(M) | FWWENEGVFSM[147]QQR[157] (SEQ ID NO: 601) | 6 |
| | Oxi(M) | DGDRWWENEGVFSM[147]QQR (SEQ ID NO: 602) | 11 |
| | Oxi(M) | DYLPLVLGPTAM[147]R (SEQ ID NO: 603) | 53 |
| | Oxi(M) | FWWENEGVFSM[147]QQR (SEQ ID NO: 604) | 338 |
| | Oxi(M) | IANVFTNAFRYGHTLIQPFM[147]FR (SEQ ID NO: 605) | 5 |
| | Oxi(M) | IGLDLPALNM[147]QR (SEQ ID NO: 606) | 24 |
| | Oxi(M) | IVGAM[147]VQIITYR (SEQ ID NO: 607) | 7 |
| | Oxi(M) | KLM[147]EQYGTPNNIDIWMGGVSEPLK (SEQ ID NO: 608) | 1 |
| | Oxi(M) | LFEQVM[147]R (SEQ ID NO: 609) | 319 |
| | Oxi(M) | LM[147]EQ[129]YGTPN[115]N[115]IDIWMGGVSEPLK (SEQ ID NO: 610) | 9 |
| | Oxi(M) | LM[147]EQ[129]YGTPNNIDIWM[147]GGVSEPLK (SEQ ID NO: 611) | 1 |
| | Oxi(M) | LM[147]EQYGTPN[115]N[115]IDIWM[147]GGVSEPLK (SEQ ID NO: 612) | 1 |
| | Oxi(M) | LM[147]EQYGTPN[115]N[115]IDIWMGGVSEPLK (SEQ ID NO: 613) | 17 |
| | Oxi(M) | LM[147]EQYGTPN[115]NIDIWMGGVSEPLK (SEQ ID NO: 614) | 23 |
| | Oxi(M) | LM[147]EQYGTPNNIDIWM[147]GGVSEPLK (SEQ ID NO: 615) | 6 |
| | Oxi(M) | LM[147]EQYGTPNNIDIWMGGVSEPLK (SEQ ID NO: 616) | 51 |
| | Oxi(M) | LM[147]EQYGTPNNIDIWMGGVSEPLKR (SEQ ID NO: 617) | 1 |
| | Oxi(M) | LMEQ[129]YGTPNNIDIWM[147]GGVSEPLK (SEQ ID NO: 618) | 4 |
| | Oxi(M) | LMEQYGTPN[115]N[115]IDIWM[147]GGVSEPLK (SEQ ID NO: 619) | 8 |
| | Oxi(M) | LMEQYGTPN[115]NIDIWM[147]GGVSEPLK (SEQ ID NO: 620) | 10 |
| | Oxi(M) | LMEQYGTPNN[115]IDIWM[147]GGVSEPLK (SEQ ID NO: 621) | 5 |
| | Oxi(M) | LMEQYGTPNNIDIWM[147]GGVSEPLK (SEQ ID NO: 622) | 33 |
| | Oxi(M) | LMEQYGTPNNIDIWM[147]GGVSEPLKR (SEQ ID NO: 623) | 1 |
| | Oxi(M) | NNIFM[147]SN[115]SYPR (SEQ ID NO: 624) | 4 |
| | Oxi(M) | NNIFM[147]SN[115]SYPRDFVNCSTLPALNLASWREAS (SEQ ID NO: 625) | 5 |
| | Oxi(M) | NNIFM[147]SNSYPR (SEQ ID NO: 626) | 239 |
| | Oxi(M) | NQINALTSFVDASM[147]VYGSEEPLAR (SEQ ID NO: 627) | 9 |
| | Oxi(M) | SLM[147]FM[147]QWGQLLDHDLDFTPEPAAR (SEQ ID NO: 628) | 8 |
| | Oxi(M) | SLM[147]FMQWGQLLDHDLDFTPEPAAR (SEQ ID NO: 629) | 33 |
| | Oxi(M) | SLMFM[147]QWGQLLDHDLDFTPEPAAR (SEQ ID NO: 630) | 45 |
| | Oxi(M) | SSEM[147]PELTSMHTLLLR (SEQ ID NO: 631) | 5 |
| | Oxi(M) | TITGM[147]CNNR (SEQ ID NO: 632) | 2 |
| | Oxi(M) | YQPM[147]EPNPR (SEQ ID NO: 633) | 35 |
| | Phospho, Oxi(M) | KIVGAM[147]VQIITY[243]R (SEQ ID NO: 634) | 2 |

TABLE 6-continued

PTMs founds in Multiple Human Cohort

| Gene | Modification | modified_peptide | Sum of sc |
|---|---|---|---|
| | Phospho, Oxi(M) | n[43]M[147]GVPFFS[167]S[167]LRCMVDLGPCWAGGLTAEMK (SEQ ID NO: 635) | 1 |
| | Phospho, Oxi(M) | SLMFM[147]QWGQLLDHDLDFT[181]PEPAAR (SEQ ID NO: 636) | 1 |
| MYH6 | Cit | AER[157]NYHIFYQILSNK (SEQ ID NO: 637) | 1 |
| | Cit | KLAEQELIETSER[157] (SEQ ID NO: 638) | 1 |
| | Cit | LQTENGELAR[157] (SEQ ID NO: 639) | 2 |
| | Cit | VIQYFASIAAIGDR[157] (SEQ ID NO: 640) | 2 |
| | Cit | VVDSLQTSLDAETR[157] (SEQ ID NO: 641) | 1.01 |
| | Cit Oxi(M) | CIIPN[115]ER[157]KAPGVM[147]DNPLVMHQLR (SEQ ID NO: 642) | 1 |
| | Cit Oxi(M) | CIIPNER[157]KAPGVM[147]DNPLVMHQLR[157] SEQ ID NO: 643) | 1 |
| | Cit Oxi(M) | LQNEIEDLM[147]VDVER[157] (SEQ ID NO: 644) | 1.98 |
| | Oxi(M) | AFM[147]GVKNWPWM[147]K (SEQ ID NO: 645) | 78.97 |
| | Oxi(M) | DEEM[147]EQAK (SEQ ID NO: 646) | 5 |
| | Oxi(M) | E[111]DQVM[147]QQNPPK (SEQ ID NO: 647) | 73.56 |
| | Oxi(M) | EKSEFKLELDDVTSNM[147]EQIIK (SEQ ID NO: 648) | 38.93 |
| | Oxi(M) | ELEEISERLEEAGGATSVQIEM[147]NKK (SEQ ID NO: 649) | 23 |
| | Oxi(M) | HRLQNEIEDLM[147]VDVER (SEQ ID NO: 650) | 74.98 |
| | Oxi(M) | IEDM[147]AM[147]LTFLHEPAVLFNLK (SEQ ID NO: 651) | 2.02 |
| | Oxi(M) | IEDMAM[147]LTFLHEPAVLFNLK (SEQ ID NO: 652) | 7 |
| | Oxi(M) | KAPGVM[147]DNPLVM[147]HQLR (SEQ ID NO: 653) | 587.43 |
| | Oxi(M) | KAPGVMDNPLVM[147]HQLR (SEQ ID NO: 654) | 293.4 |
| | Oxi(M) | LEDEEEM[147]NAELTAKK (SEQ ID NO: 655) | 6 |
| | Oxi(M) | LM[147]ATLFSSYATADTGDSGK (SEQ ID NO: 656) | 6 |
| | Oxi(M) | LQNEIEDLM[147]VDVERSNAAAAALDKK (SEQ ID NO: 657) | 4 |
| | Oxi(M) | LSYTQQM[147]EDLK (SEQ ID NO: 658) | 265.95 |
| | Oxi(M) | M[147]RRDLEEATLQHEATAAALR (SEQ ID NO: 659) | 18.93 |
| | Oxi(M) | M[147]VSLLQEKNDLQLQVQAEQDNLADAEER (SEQ ID NO: 660) | 31.73 |
| | Oxi(M) | n[43]TDAQM[147]ADFGAAAQYLR (SEQ ID NO: 661) | 509.15 |
| | Oxi(M) | n[43]TDAQM[147]ADFGAAAQYLRK (SEQ ID NO: 662) | 3.94 |
| | Oxi(M) | NM[147]EQT1K (SEQ ID NO: 663) | 127.95 |
| | Oxi(M) | NM[147]EQTIKDLQHR (SEQ ID NO: 664) | 5 |
| | Oxi(M) | Q[111]REEQAEPDGTEDADKSAYLM[147]GLNSADLLK (SEQ ID NO: 665) | 214.78 |
| | Oxi(M) | SEAPPHIFSISDNAYQYM[147]LTDRENQSILITGESGAGK (SEQ ID NO: 666) | 45.88 |
| | Oxi(M) | TLEDQM[147]NEHRSKAEETQR (SEQ ID NO: 667) | 12.95 |
| | Oxi(M) | VKNLTEEM[147]AGLDEITAK (SEQ ID NO: 668) | 21.88 |
| | Phospho | ELT[181]YQTEEDKK (SEQ ID NO: 669) | 4 |
| | Phospho | ELTY[243]QTEEDKK (SEQ ID NO: 670) | 22 |
| | Phospho | GQSVQQVY[243]YSIGALAK (SEQ ID NO: 671) | 2 |
| | Phospho | GQSVQQVYY[243]SIGALAK (SEQ ID NO: 672) | 2 |
| | Phospho | IKELTY[243]QTEEDKK (SEQ ID NO: 673) | 25 |
| | Phospho | IKELTYQT[181]EEDKK (SEQ ID NO: 674) | 11 |
| | Phospho | KDIDDLELT[181]LAK (SEQ ID NO: 675) | 4 |
| | Phospho | MESDLT[181]QLQSEVEEAVQECR (SEQ ID NO: 676) | 2 |
| | Phospho | n[43]MT[181]DAQMADFGAAAQYLRK (SEQ ID NO: 677) | 1 |
| | Phospho | S[167]AYLMGLNSADLLK (SEQ ID NO: 678) | 9.98 |
| | Phospho | TLEDQANEY[243]R (SEQ ID NO: 679) | 67 |
| | Phospho, Oxi(M) | S[167]AYLM[147]GLNSADLLK (SEQ ID NO: 680) | 34.85 |
| | Phospho, Oxi(M) | SAY[243]LM[147]GLNSADLLK (SEQ ID NO: 681) | 87.59 |
| MYH7 | Cit | DTQIQLDDAVR[157] (SEQ ID NO: 682) | 7 |
| | Cit | HADSVAELGEQIDNLQR[157] (SEQ ID NO: 683) | 5.95 |
| | Cit | HR[157]LQNEIEDLMVDVER (SEQ ID NO: 684) | 1 |
| | Cit | ILNPAAIPEGQFIDSR[157] (SEQ ID NO: 685) | 1.98 |
| | Cit | KMDADLSQLQTEVEEAVQECR[157] (SEQ ID NO: 686) | 2.94 |
| | Cit | LAEKDEEMEQAKR[157] (SEQ ID NO: 687) | 1 |
| | Cit | LQNEIEDLMVDVER[157] (SEQ ID NO: 688) | 1 |
| | Cit | LQTENGELSR[157] (SEQ ID NO: 689) | 1 |
| | Cit | MDADLSQLQTEVEEAVQECR[157] (SEQ ID NO: 690) | 0.98 |
| | Cit | MFNWMVTR[157] (SEQ ID NO: 691) | 1 |
| | Cit | N[115]NLLQAELEELR[157] (SEQ ID NO: 692) | 2 |
| | Cit | NALAHALQSAR[157] (SEQ ID NO: 693) | 1 |
| | Cit | NDLQLQVQAEQDN[115]LADAEER[157] (SEQ ID NO: 694) | 0.99 |
| | Cit | NDLQLQVQAEQDNLADAEER[157] (SEQ ID NO: 695) | 7.96 |
| | Cit | NN[115]LLQAELEELR[157] (SEQ ID NO: 696) | 1 |
| | Cit | NNLLQAELEELR[157] (SEQ ID NO: 697) | 1 |
| | Cit | QR[157]EEQAEPDGTEEADK (SEQ ID NO: 698) | 3.96 |

TABLE 6-continued

PTMs founds in Multiple Human Cohort

| Gene | Modification | modified_peptide | Sum of sc |
|------|--------------|------------------|-----------|
| | Cit | R[157]NNLLQAELEELR (SEQ ID NO: 699) | 4 |
| | Cit | SEAPPHIFSISDNAYQYMLTDR[157] (SEQ ID NO: 700) | 2 |
| | Cit | SVNDLTSQR[157] (SEQ ID NO: 701) | 0.99 |
| | Cit | TLEDQMNEHR[157] (SEQ ID NO: 702) | 2.97 |
| | Cit | VIQYFAVIAAIGDR[157] (SEQ ID NO: 703) | 1 |
| | Cit | VQHELDEAEER[157] (SEQ ID NO: 704) | 1 |
| | Cit | VQHELDEAEER[157]ADIAESQVNK (SEQ ID NO: 705) | 1 |
| | Cit | VR[157]ELENELEAEQK (SEQ ID NO: 706) | 0.98 |
| | Cit | M[147]DADLSQLQTEVEEAVQECR[157] (SEQ ID NO: 707) | 0.98 |
| | Oxi(M) | AGLLGLLEEM[147]R (SEQ ID NO: 708) | 761.55 |
| | Oxi(M) | AGLLGLLEEM[147]RDER (SEQ ID NO: 709) | 819.02 |
| | Oxi(M) | AVYERM[147]FNWMVTR (SEQ ID NO: 710) | 0.99 |
| | Oxi(M) | E[111]GIEWTFIDFGMDLQACIDLIEKPM[147]GIM[147]SILEEECMFPK (SEQ ID NO: 711) | 1 |
| | Oxi(M) | E[111]KEM[147]ASM[147]KEEFTR (SEQ ID NO: 712) | 3 |
| | Oxi(M) | EDQ[129]VM[147]Q[129]QNPPK (SEQ ID NO: 713) | 2 |
| | Oxi(M) | EDQVM[147]Q[129]QNPPK (SEQ ID NO: 714) | 2 |
| | Oxi(M) | EDQVM[147]QQ[129]NPPK (SEQ ID NO: 715) | 4 |
| | Oxi(M) | EDQVM[147]QQN[115]PPK (SEQ ID NO: 716) | 1 |
| | Oxi(M) | EDQVM[147]QQNPPK (SEQ ID NO: 717) | 3196.87 |
| | Oxi(M) | EDQVM[147]QQNPPKFDK (SEQ ID NO: 718) | 195.44 |
| | Oxi(M) | EDQVM[147]QQNPPKFDKIEDMAMLTFLHEPAVLYNLK (SEQ ID NO: 719) | 1 |
| | Oxi(M) | EDQVMQQNPPKFDKIEDM[147]AMLTFLHEPAVLYNLK (SEQ ID NO: 720) | 1 |
| | Oxi(M) | EEQAEPDGTEEADKSAYLM[147]GLNSADLLK (SEQ ID NO: 721) | 59.82 |
| | Oxi(M) | EKEM[147]ASM[147]KEEFTR (SEQ ID NO: 722) | 20 |
| | Oxi(M) | EKEMASM[147]KEEFTR (SEQ ID NO: 723) | 7 |
| | Oxi(M) | ELEEISERLEEAGGATSVQIEM[147]NK (SEQ ID NO: 724) | 270.51 |
| | Oxi(M) | EM[147]ASM[147]KEEFTR (SEQ ID NO: 725) | 6 |
| | Oxi(M) | EM[147]ASMKEEFTR (SEQ ID NO: 726) | 2 |
| | Oxi(M) | EM[147]NERLEDEEEM[147]NAELTAK (SEQ ID NO: 727) | 24 |
| | Oxi(M) | EM[147]NERLEDEEEMNAELTAK (SEQ ID NO: 728) | 1 |
| | Oxi(M) | EM[147]NERVEDEEEMNAELTAK (SEQ ID NO: 729) | 1 |
| | Oxi(M) | EMASM[147]KEEFTR (SEQ ID NO: 730) | 5 |
| | Oxi(M) | EMNERLEDEEEM[147]NAELTAK (SEQ ID NO: 731) | 11 |
| | Oxi(M) | FDKIEDM[147]AM[147]LTFLHEPAVLYNLK (SEQ ID NO: 732) | 34.82 |
| | Oxi(M) | FDKIEDM[147]AMLTFLHEPAVLYNLK (SEQ ID NO: 733) | 75.78 |
| | Oxi(M) | FDKIEDMAM[147]LTFLHEPAVLYNLK (SEQ ID NO: 734) | 86.73 |
| | Oxi(M) | GDSEM[147]AVFGAAAPYLR (SEQ ID NO: 735) | 3 |
| | Oxi(M) | IEDM[147]AM[147]LTFLHEPAVLYNLK (SEQ ID NO: 736) | 202.41 |
| | Oxi(M) | IEDM[147]AMLTFLHEPAVLYNLK (SEQ ID NO: 19) | 192.62 |
| | Oxi(M) | IEDMAM[147]LTFLHEPAVLYN[115]LK (SEQ ID NO: 737) | 2 |
| | Oxi(M) | IEDMAM[147]LTFLHEPAVLYNLK (SEQ ID NO: 738) | 162.63 |
| | Oxi(M) | KAITDAAM[147]M[147]AEELK (SEQ ID NO: 739) | 6.04 |
| | Oxi(M) | KKM[147]DADLSQLQTEVEEAVQECR (SEQ ID NO: 740) | 186.12 |
| | Oxi(M) | KKM[147]EGDLNEM[147]EIQLSHANR (SEQ ID NO: 741) | 111.96 |
| | Oxi(M) | KKM[147]EGDLNEMEIQLSHANR (SEQ ID NO: 742) | 19.9 |
| | Oxi(M) | KLAEKDEEM[147]EQAK (SEQ ID NO: 743) | 133.92 |
| | Oxi(M) | KM[147]DADLSQLQTEVEEAVQECR (SEQ ID NO: 744) | 1755.23 |
| | Oxi(M) | KM[147]EGDLNEM[147]EIQLSHANR (SEQ ID NO: 745) | 1025.97 |
| | Oxi(M) | KM[147]EGDLNEMEIQLSHANR (SEQ ID NO: 746) | 540.23 |
| | Oxi(M) | KMEGDLNEM[147]EIQLSHANR (SEQ ID NO: 747) | 401.31 |
| | Oxi(M) | KQLEAEKM[147]ELQSALEEAEASLEHEEGK (SEQ ID NO: 748) | 4 |
| | Oxi(M) | LAEKDEEM[147]EQAK (SEQ ID NO: 749) | 590.48 |
| | Oxi(M) | LAEKDEEM[147]EQAKR (SEQ ID NO: 750) | 168.85 |
| | Oxi(M) | LEDEEEM[147]N[115]AELTAK (SEQ ID NO: 751) | 7 |
| | Oxi(M) | LEDEEEM[147]NAELTAK (SEQ ID NO: 752) | 2324.18 |
| | Oxi(M) | LEEAGGATSVQIEM[147]N[115]K (SEQ ID NO: 753) | 2 |
| | Oxi(M) | LEEAGGATSVQIEM[147]NK (SEQ ID NO: 754) | 4631.4 |
| | Oxi(M) | LEEAGGATSVQIEM[147]NKK (SEQ ID NO: 755) | 235.96 |
| | Oxi(M) | LELDDVTSN[115]M[147]EQIIK (SEQ ID NO: 756) | 1 |
| | Oxi(M) | LELDDVTSNM[147]EQIIK (SEQ ID NO: 757) | 1755.4 |
| | Oxi(M) | LQN[115]EIEDLM[147]VDVER (SEQ ID NO: 758) | 3 |
| | Oxi(M) | LQNEIEDLM[147]VDVER (SEQ ID NO: 759) | 2002.45 |
| | Oxi(M) | LQQFFNHHM[147]FVLEQEEYK (SEQ ID NO: 760) | 515.41 |
| | Oxi(M) | LQQFFNHHM[147]FVLEQEEYKK (SEQ ID NO: 761) | 223.89 |
| | Oxi(M) | LTGAIM[147]HFGNM[147]K (SEQ ID NO: 762) | 140.53 |
| | Oxi(M) | LTGAIM[147]HFGNMK (SEQ ID NO: 763) | 102.67 |
| | Oxi(M) | LTGAIMHFGNM[147]K (SEQ ID NO: 764) | 170.33 |
| | Oxi(M) | LTQESIM[147]DLEN[115]DK (SEQ ID NO: 765) | 6 |
| | Oxi(M) | LTQESIM[147]DLENDK (SEQ ID NO: 766) | 2834.72 |
| | Oxi(M) | LTQESIM[147]DLENDKQQLDER (SEQ ID NO: 767) | 2917.8 |
| | Oxi(M) | M[147]AAEAQKQVK (SEQ ID NO: 768) | 1 |

TABLE 6-continued

PTMs founds in Multiple Human Cohort

| Gene | Modification | modified_peptide | Sum of sc |
|---|---|---|---|
| | Oxi(M) | M[147]DADLSQLQTEVEEAVQECR (SEQ ID NO: 769) | 3098.33 |
| | Oxi(M) | M[147]EGDLNEM[147]EIQLSHANR (SEQ ID NO : 770) | 728.13 |
| | Oxi(M) | M[147]EGDLNEMEIQLSHANR (SEQ ID NO: 771) | 637.86 |
| | Oxi(M) | M[147]ELQ[129]SALEEAEASLEHEEGK (SEQ ID NO: 772) | 0.98 |
| | Oxi(M) | M[147]ELQSALEEAEASLEHEEGK (SEQ ID NO: 773) | 108.4 |
| | Oxi(M) | M[147]FNWM[147]VTR (SEQ ID NO: 774) | 454.13 |
| | Oxi(M) | M[147]FNWMVTR (SEQ ID NO: 775) | 318.3 |
| | Oxi(M) | M[147]VSLLQ[129]EK (SEQ ID NO: 776) | 4 |
| | Oxi(M) | M[147]VSLLQEK (SEQ ID NO: 777) | 957.46 |
| | Oxi(M) | MEGDLNEM[147]EIQLSHANR (SEQ ID NO: 778) | 266.34 |
| | Oxi(M) | MFNWM[147]VTR (SEQ ID NO: 779) | 293.04 |
| | Oxi(M) | N[115]LTEEM[147]AGLDEITAK (SEQ ID NO: 780) | 1 |
| | Oxi(M) | n[43]GDSEM[147]AVFGAAAPYLR (SEQ ID NO: 781) | 74 |
| | Oxi(M) | n[43]GDSEM[147]AVFGAAAPYLRK (SEQ ID NO: 782) | 50 |
| | Oxi(M) | NAESVKGM[147]R (SEQ ID NO: 783) | 8 |
| | Oxi(M) | NLTEEM[147]AGLDEITAK (SEQ ID NO: 784) | 2195.5 |
| | Oxi(M) | NSM[147]YKLTGAIM[147]HFGNM[147]K (SEQ ID NO: 785) | 26 |
| | Oxi(M) | Q[111]LEAEKM[147]ELQSALEEAEASLEHEEGK (SEQ ID NO: 786) | 19 |
| | Oxi(M) | Q[111]REEQAEPDGTEEADKSAYLM[147]GLNSADLLK (SEQ ID NO: 787) | 145.77 |
| | Oxi(M) | QLEAEKM[147]ELQSALEEAEASLEHEEGK (SEQ ID NO: 788) | 17 |
| | Oxi(M) | QREEQAEPDGTEEADKSAYLM[147]GLNSADLLK (SEQ ID NO: 789) | 167.8 |
| | Oxi(M) | RSEAPPHIFSISDNAYQYM[147]LTDR (SEQ ID NO: 790) | 147.8 |
| | Oxi(M) | SAETEKEM[147]ATMK (SEQ ID NO: 791) | 1.96 |
| | Oxi(M) | SAYLM[147]GLN[115]SADLLK (SEQ ID NO: 792) | 2 |
| | Oxi(M) | SAYLM[147]GLNSADLLK (SEQ ID NO: 793) | 980.71 |
| | Oxi(M) | SEAPPHIFSISDN[115]AYQYM[147]LTDR (SEQ ID NO: 794) | 5 |
| | Oxi(M) | SEAPPHIFSISDNAYQYM[147]LTDR (SEQ ID NO: 795) | 488.82 |
| | Oxi(M) | SEFKLELDDVTSNM[147]EQIIK (SEQ ID NO: 796) | 104.92 |
| | Oxi(M) | SPGVM[147]DNPLVM[147]HQLR (SEQ ID NO: 797) | 166.8 |
| | Oxi(M) | SPGVM[147]DNPLVMHQLR (SEQ ID NO: 798) | 254.51 |
| | Oxi(M) | SPGVMDNPLVM[147]HQLR (SEQ ID NO: 799) | 242.53 |
| | Oxi(M) | TLEDQM[147]NEHR (SEQ ID NO: 800) | 362.14 |
| | Oxi(M) | TLEDQM[147]NEHRSK (SEQ ID NO: 801) | 2 |
| | Oxi(M) | TVTVKEDQVM[147]QQNPPK (SEQ ID NO: 802) | 227.08 |
| | Oxi(M) | TVTVKEDQVM[147]QQNPPKFDK (SEQ ID NO: 803) | 121.05 |
| | Oxi(M) | VFFKAGLLGLLEEM[147]RDER (SEQ ID NO: 804) | 28.85 |
| | Oxi(M) | VKEM[147]NERLEDEEEM[147]NAELTAK (SEQ ID NO: 805) | 60 |
| | Oxi(M) | VKEM[147]NERLEDEEEMNAELTAK (SEQ ID NO: 806) | 5 |
| | Oxi(M) | VKEMNERLEDEEEM[147]NAELTAK (SEQ ID NO: 807) | 13 |
| | Oxi(M) | VRM[147]DLER (SEQ ID NO: 808) | 1 |
| | Phospho | E[111]LTY[243]QTEEDRK (SEQ ID NO: 809) | 2.85 |
| | Phospho | ELT[181]YQTEEDRK (SEQ ID NO: 810) | 4.79 |
| | Phospho | ELTY[243]QTEEDR (SEQ ID NO: 811) | 2.85 |
| | Phospho | ELTY[243]QTEEDRK (SEQ ID NO: 812) | 120.33 |
| | Phospho | ELTYQT[181]EEDRK (SEQ ID NO: 813) | 0.94 |
| | Phospho | EN[115]Q[129]SILITGES[167]GAGK[171] (SEQ ID NO: 814) | 1 |
| | Phospho | EQY[243]EEETEAK (SEQ ID NO: 815) | 2.95 |
| | Phospho | GDS[167]EMAVFGAAAPYLR (SEQ ID NO: 816) | 22 |
| | Phospho | GKLT[181]YTQQLEDLK (SEQ ID NO: 817) | 0.99 |
| | Phospho | GKLTY[243]TQQLEDLK (SEQ ID NO: 818) | 167.31 |
| | Phospho | GKLTY[243]TQQLEDLKR (SEQ ID NO: 819) | 241.57 |
| | Phospho | GKLTYT[181]QQLEDLK (SEQ ID NO: 820) | 12.88 |
| | Phospho | GKLTYT[181]QQLEDLKR (SEQ ID NO: 821) | 7.92 |
| | Phospho | GT[181]LEDQIIQANPALEAFGNAK (SEQ ID NO: 822) | 3 |
| | Phospho | HADS[167]VAELGEQIDNLQR (SEQ ID NO: 823) | 542.65 |
| | Phospho | IKELT[181]YQTEEDRK (SEQ ID NO: 824) | 61.35 |
| | Phospho | IKELTY[243]QTEEDR (SEQ ID NO: 825) | 4.92 |
| | Phospho | IKELTY[243]QTEEDRK (SEQ ID NO: 826) | 64.32 |
| | Phospho | IKELTYQT[181]EEDRK (SEQ ID NO: 827) | 8.91 |
| | Phospho | LKNAY[243]EESLEHLETFK (SEQ ID NO: 828) | 92.5 |
| | Phospho | LKNAY[243]EESLEHLETFKR (SEQ ID NO: 829) | 149.13 |
| | Phospho | LKNAYEES[167]LEHLETFKR (SEQ ID NO: 830) | 11.94 |
| | Phospho | LLSSLDIDHNQY[243]K (SEQ ID NO: 831) | 90.51 |
| | Phospho | LT[181]YTQQLEDLK (SEQ ID NO: 832) | 3.96 |
| | Phospho | LT[181]YTQQLEDLKR (SEQ ID NO: 833) | 104.94 |
| | Phospho | LTY[243]TQQLEDLK (SEQ ID NO: 834) | 491.04 |
| | Phospho | LTY[243]TQQLEDLKR (SEQ ID NO: 835) | 1101.94 |
| | Phospho | LTYT[181]QQLEDLKR (SEQ ID NO: 836) | 23.76 |
| | Phospho | LY[243]DNHLGK (SEQ ID NO: 837) | 25.87 |
| | Phospho | NAY[243]EESLEHLETFK (SEQ ID NO: 838) | 165.08 |
| | Phospho | NAY[243]EESLEHLETFKR (SEQ ID NO: 839) | 156.14 |
| | Phospho | NKDPLNETVVALY[243]QK (SEQ ID NO: 840) | 7.96 |
| | Phospho | Q[111]KY[243]EESQSELESSQK (SEQ ID NO: 841) | 144.62 |
| | Phospho | QKY[243]EESQSELESSQK (SEQ ID NO: 842) | 219.71 |

TABLE 6-continued

PTMs founds in Multiple Human Cohort

| Gene | Modification | modified_peptide | Sum of sc |
|---|---|---|---|
| | Phospho | QKYEES[167]QSELESSQK (SEQ ID NO: 843) | 22.82 |
| | Phospho | RIKELT[181]Y[243]QT[181]EEDR (SEQ ID NO: 844) | 1 |
| | Phospho | SAY[243]LMGLNSADLLK (SEQ ID NO: 845) | 13.91 |
| | Phospho | T[181]KYETDAIQR (SEQ ID NO: 846) | 7.78 |
| | Phospho | TKY[243]ETDAIQR (SEQ ID NO: 847) | 420.65 |
| | Phospho | TKYET[181]DAIQR (SEQ ID NO: 848) | 28.11 |
| | Phospho, Oxi(M) | IEDM[147]AM[147]LTFLHEPAVLY[243]NLK (SEQ ID NO: 849) | 34 |
| | Phospho, Oxi(M) | RSEAPPHIFSISDNAYQY[243]M[147]LTDR (SEQ ID NO: 850) | 10 |
| | Phospho, Oxi(M) | SEAPPHIFSISDNAYQY[243]M[147]LTDR (SEQ ID NO: 851) | 50 |
| NPPB | Oxi(M) | KM[147]VLYTLR (SEQ ID NO: 852) | 1 |
| | Oxi(M) | M[147]VLYTLR (SEQ ID NO: 853) | 47 |
| | Oxi(M) | M[147]VQGSGCFGR (SEQ ID NO: 854) | 6 |
| PFN1 | Cit | C[143]SVIR[157]DSLLQ[129]DGEFSMDLR[157]TK (SEQ ID NO: 855) | 8 |
| | Cit | CSVIR[157]DSLLQ[129]DGEFSMDLRIK (SEQ ID NO: 856) | 9 |
| | Cit | CSVIR[157]DSLLQDGEFSMDLR[157] (SEQ ID NO: 857) | 2 |
| | Cit | CSVIR[157]DSLLQDGEFSMDLRIK (SEQ ID NO: 858) | 16 |
| | Cit | CSVIRDSLLQ[129]DGEFSMDLR[157]TK (SEQ ID NO: 859) | 7 |
| | Cit | CSVIRDSLLQDGEFSMDLR[157]TK (SEQ ID NO: 860) | 43 |
| | Cit | DR[157]SSFYVN[115]GLTLGGQ[129]1( (SEQ ID NO: 861) | 3 |
| | Cit | DR[157]SSFYVN[115]GLTLGGQK (SEQ ID NO: 862) | 9.96 |
| | Cit | DSLLQDGEFSMDLR[157] (SEQ ID NO: 863) | 3 |
| | Cit | TFVN[115]ITPAEVGVLVGKDR[157] (SEQ ID NO: 864) | 2 |
| | Cit | TFVNITPAEVGVLVGKDR[157] (SEQ ID NO: 865) | 18 |
| | Cit Oxi(M) | CSVIR[157]DSLLQDGEFSM[147]DLRIK (SEQ ID NO: 866) | 8 |
| | Cit Oxi(M) | CSVIRDSLLQDGEFSM[147]DLR[157]TK (SEQ ID NO: 867) | 4 |
| | Cit Oxi(M) | DSLLQ[129]DGEFSM[147]DLR[157] (SEQ ID NO: 868) | 4 |
| | Cit Oxi(M) | DSLLQDGEFSM[147]DLR[157] (SEQ ID NO: 869) | 12 |
| | Oxi(M) | C[143]SVIRDSLLQ[129]DGEFSM[147]DLRIK (SEQ ID NO: 870) | 6 |
| | Oxi(M) | C[143]SVIRDSLLQDGEFSM[147]DLWIK (SEQ ID NO: 871) | 20 |
| | Oxi(M) | C[143]YEM[147]ASHLR (SEQ ID NO: 872) | 235 |
| | Oxi(M) | C[160]YEM[147]ASHLR (SEQ ID NO: 873) | 2 |
| | Oxi(M) | C[228]YEM[147]A5HLR (SEQ ID NO: 874) | 26 |
| | Oxi(M) | C[402]YEM[147]ASHLR (SEQ ID NO: 875) | 17 |
| | Oxi(M) | C[407]YEM[147]ASHLR (SEQ ID NO: 876) | 75 |
| | Oxi(M) | C[407]YEM[147]ASHLRR (SEQ ID NO: 877) | 2 |
| | Oxi(M) | C[432]YEM[147]A5HLR (SEQ ID NO: 878) | 54 |
| | Oxi(M) | CSVIRDSLLQ[129]DGEFSM[147]DLRIK (SEQ ID NO: 879) | 7 |
| | Oxi(M) | CSVIRDSLLQDGEFSM[147]DLR (SEQ ID NO: 880) | 2 |
| | Oxi(M) | CSVIRDSLLQDGEFSM[147]DLWIK (SEQ ID NO: 881) | 11 |
| | Oxi(M) | CYEM[147]ASHLR (SEQ ID NO: 882) | 165 |
| | Oxi(M) | CYEM[147]ASHLR[16] (SEQ ID NO: 883) | 1 |
| | Oxi(M) | CYEM[147]ASHLRR (SEQ ID NO: 884) | 4 |
| | Oxi(M) | DSLLQ[129]DGEFSM[147]DLR (SEQ ID NO: 885) | 3 |
| | Oxi(M) | DSLLQDGEFSM[147]DLR (SEQ ID NO: 886) | 2114.96 |
| | Oxi(M) | KC[402]YEM[147]ASHLR (SEQ ID NO: 887) | 2 |
| | Oxi(M) | M[147]AGWNAYIDNLMADGTCQDAAIVGYK (SEQ ID NO: 888) | 1 |
| | Oxi(M) | n[43]AGWNAYIDNLM[147]ADGTC[160]QDAAIVGYK (SEQ ID NO: 889) | 4 |
| | Oxi(M) | n[43]AGWNAYIDNLM[147]ADGTCQDAAIVGYK (SEQ ID NO: 890) | 49 |
| | Oxi(M) | n[43]M[147]AGWN[115]AYIDN[115]LM[147]ADGTCQ[129]DAAIVGYK (SEQ ID NO: 891) | 4 |
| | Oxi(M) | TDKTLVLLM[147]GK (SEQ ID NO: 892) | 13 |
| | Oxi(M) | TDKTLVLLM[147]GKEGVHGGLINK (SEQ ID NO: 893) | 12 |
| | Oxi(M) | TLVLLM[147]GK (SEQ ID NO: 894) | 801.71 |
| | Oxi(M) | TLVLLM[147]GKEGVHGGLINK (SEQ ID NO: 895) | 4 |
| | Phospho | AGWNAY[243]IDNLMADGT[181]CQDAAIVGY[243]K (SEQ ID NO: 896) | 3 |
| | Phospho | AGWNAY[243]IDNLMADGTCQDAAIVGYK (SEQ ID NO: 897) | 527.7 |
| | Phospho | AGWNAY[243]IDNLMADGTCQDAAIVGYKDSPSVWAAVPGK (SEQ ID NO: 898) | 6 |
| | Phospho | n[43]AGWNAYIDNLMADGT[181]CQDAAIVGYK (SEQ ID NO: 899) | 44 |
| | Phospho | n[43]GWNAY[243]IDNLMADGT[181]CQDAAIVGY[243]K (SEQ ID NO: 900) | 2 |
| | Phospho | n[43]MAGWNAY[243]IDNLMADGT[181]CQDAAIVGY[243]K (SEQ ID NO: 901) | 19 |

TABLE 6-continued

PTMs founds in Multiple Human Cohort

| Gene | Modification | modified_peptide | Sum of sc |
|---|---|---|---|
| | Phospho, Oxi(M) | AGWNAY[243]IDNLM[147]ADGT[181]CQDAAIVGYK (SEQ ID NO: 902) | 2 |
| | Phospho, Oxi(M) | AGWNAY[243]IDNLM[147]ADGTCQDAAIVGYK (SEQ ID NO: 903) | 218 |
| | Phospho, Oxi(M) | AGWNAY[243]IDNLM[147]ADGTCQDAAIVGYKDSPSVWAAVPGK (SEQ ID NO: 904) | 7 |
| | Phospho, Oxi(M) | CY[243]EM[147]ASHLR (SEQ ID NO: 905) | 8 |
| | Phospho, Oxi(M) | DS[167]LLQDGEFS[167]M[147] (SEQ ID NO: 906) | 1 |
| | Phospho, Oxi(M) | n[43]AGWNAYIDNLM[147]ADGT[181]CQDAAIVGYK (SEQ ID NO: 907) | 9 |
| | Phospho, Oxi(M) | n[43]M[147]AGWNAYIDNLM[147]ADGT[181]CQDAAIVGY[243]K (SEQ ID NO: 908) | 1 |
| | Phospho, Oxi(M) | T[181]DKT[181]LVLLM[147]GKEGVHGGLINK (SEQ ID NO: 909) | 2 |
| PRDX2 | Cit | EGGLGPLNIPLLADVTR[157] (SEQ ID NO: 20) | 3 |
| | Cit | EGGLGPLNIPLLADVTR[157]R (SEQ ID NO: 910) | 0.99 |
| | Cit | EGGLGPLNIPLLADVTRR[157] (SEQ ID NO: 911) | 0.99 |
| | Cit | GKYVVLFFYPLDFTFVCPTEIIAFSNR[157] (SEQ ID NO: 912) | 0.99 |
| | Cit | KEGGLGPLNIPLLADVTR[157] (SEQ ID NO: 913) | 10 |
| | Cit | KEGGLGPLNIPLLADVTR[157]R (SEQ ID NO: 914) | 21 |
| | Cit | KEGGLGPLNIPLLADVTRR[157] (SEQ ID NO: 915) | 6 |
| | Cit | KLGCEVLGVSVDSQFTHLAWINTPR[157] (SEQ ID NO: 916) | 47 |
| | Cit | LGCEVLGVSVDSQFTHLAWINTPR[157] (SEQ ID NO: 917) | 7.99 |
| | Cit | LGCEVLGVSVDSQFTHLAWINTPR[157]K (SEQ ID NO: 918) | 0.99 |
| | Cit | QITVNDLPVGR[157] (SEQ ID NO: 919) | 1 |
| | Cit | R[157]LSEDYGVLK (SEQ ID NO: 21) | 3 |
| | Cit | R[157]LSEDYGVLKTDEGIAYR (SEQ ID NO: 920) | 3 |
| | Cit | R[157]LSEDYGVLKTDEGIAYR[157] (SEQ ID NO: 921) | 5 |
| | Cit | RLSEDYGVLKTDEGIAYR[157] (SEQ ID NO: 922) | 6 |
| | Cit | SVDEALR[157] (SEQ ID NO: 923) | 2 |
| | Cit | TDEGIAYR[157] (SEQ ID NO: 924) | 58 |
| | Oxi(M) | IM[147]ETLPPK (SEQ ID NO: 924) | 1 |
| S100A12 | Cit | LEEHLEGIVNIFHQYSVR[157] (SEQ ID NO: 925) | 13 |
| | Cit | TKLEEHLEGIVN[115]IFHQYSVR[157]K (SEQ ID NO: 926) | 7 |
| | Cit | TKLEEHLEGIVNIFHQYSVR[157] (SEQ ID NO: 927) | 11 |
| | Cit | TKLEEHLEGIVNIFHQYSVR[157]K (SEQ ID NO: 928) | 1 |
| S100A4 | Cit | ELLTR[157]ELPSFLGK (SEQ ID NO: 929) | 6 |
| | Cit | R[157]TDEAAFQK (SEQ ID NO: 930) | 17 |
| | Oxi(M) | ALDVM[147]VSTFHK (SEQ ID NO: 931) | 340 |
| | Oxi(M) | LM[147]SNLDSNR (SEQ ID NO: 932) | 443 |
| | Oxi(M) | LM[147]SNLDSNRDNEVDFQEYCVFLSCIAMMCNEFFEGFPDKQPR (SEQ ID NO: 933) | 1 |
| | Oxi(M) | LMSNLDSNRDNEVDFQEYCVFLSCIAM[147]MCNEFFEGFPDKQPR (SEQ ID NO: 934) | 1 |
| | Phospho | DNEVDFQEY[243]CVFLS[167]CIAMMCNEFFEGFPDK (SEQ ID NO: 935) | 1 |
| S100A6 | Cit | LQDAEIAR[157] (SEQ ID NO: 936) | 1 |
| | Cit | LQ[129]DAEIAR[157]LM[147]EDLDRNK (SEQ ID NO: 937) | 1 |
| | Oxi(M) | LM[147]EDLDR (SEQ ID NO: 938) | 1261.91 |
| | Oxi(M) | LM[147]EDLDRNI(DQEVNFQEYVTFLGALALIYNEALKG (SEQ ID NO: 1246) | 2 |
| | Oxi(M) | LQ[129]DAEIARLM[147]EDLDRNK (SEQ ID NO: 939) | 4 |
| | Oxi(M) | LQDAEIARLM[147]EDLDRNK (SEQ ID NO: 940) | 29 |
| | Oxi(M) | M[147]ACPLDQ[129]AIGLLVAIFHK (SEQ ID NO: 941) | 6 |
| | Oxi(M) | M[147]ACPLDQAIGLLVAIFHK (SEQ ID NO: 942) | 1 |
| | Oxi(M) | n[431]M[147]ACPLDQAIGLLVAIFHK (SEQ ID NO: 943) | 8 |
| S100A7 | Oxi(M) | IEKPSLLTM[147]MK (SEQ ID NO: 944) | 6 |
| | Oxi(M) | SIIGM[147]IDM[147]FHK (SEQ ID NO: 23) | 181 |
| | Oxi(M) | SIIGM[147]IDMFHK (SEQ ID NO: 945) | 32 |
| | Oxi(M) | SIIGMIDM[147]FHK (SEQ ID NO: 24) | 71 |
| | Phospho | Q[112]S[167]HGAAPCS[167]GGS[167]Q[129] (SEQ ID NO: 25) | 6 |
| S100A9 | Cit | MSQLER[157]N[115]IETIINTFHQ[129]YSVK (SEQ ID NO: 946) | 4 |
| | Cit | MSQLER[157]NIETIIN[115]TFHQYSVK (SEQ ID NO: 947) | 14 |
| | Cit | MSQLER[157]NIETIINTFHQ[129]YSVK (SEQ ID NO: 948) | 1 |
| | Cit | MSQLER[157]NIETIINTFHQYSVK (SEQ ID NO: 949) | 35 |
| | Cit | Q[129]LSFEEFIMLMAR[157] (SEQ ID NO: 950) | 1 |

TABLE 6-continued

PTMs founds in Multiple Human Cohort

| Gene | Modification | modified_peptide | Sum of sc |
|---|---|---|---|
| | Cit | QLSFEEFIMLMAR[157] (SEQ ID NO: 951) | 1 |
| | Cit | QLSFEEFIMLMAR[157]LTWASHEK (SEQ ID NO: 952) | 11 |
| | Cit Oxi(M) | M[147]SQLER[157]N[115]IETIIN[115]TFHQYSVK (SEQ ID NO: 953) | 1 |
| | Cit Oxi(M) | M[147]SQLER[157]N[115]IETIINTFHQYSVK (SEQ ID NO: 954) | 4 |
| | Cit Oxi(M) | M[147]SQLER[157]NIETIIN[115]TFHQ[129]YSVK (SEQ ID NO: 955) | 12 |
| | Cit Oxi(M) | M[147]SQLER[157]NIETIIN[115]TFHQYSVK (SEQ ID NO: 956) | 14 |
| | Cit Oxi(M) | M[147]SQLER[157]NIETIINTFHQ[129]YSVK (SEQ ID NO: 957) | 4 |
| | Cit Oxi(M) | M[147]SQLER[157]NIETIINTFHQYSVK (SEQ ID NO: 958) | 7 |
| | Oxi(M) | M[147]HEGDEGPGHHHK (SEQ ID NO: 959) | 5 |
| | Oxi(M) | M[147]HEGDEGPGHHHKPGLGEGTP (SEQ ID NO: 960) | 3823 |
| | Oxi(M) | M[147]SQ[129]LERNIETIIN[115]TFHQYSVK (SEQ ID NO: 961) | 15 |
| | Oxi(M) | M[147]SQ[129]LERNIETIINTFHQ[129]YSVK (SEQ ID NO : 962) | 1 |
| | Oxi(M) | M[147]SQ[129]LERNIETIINTFHQYSVK (SEQ ID NO: 963) | 14 |
| | Oxi(M) | M[147]SQLERN[115]IETIIN[115]TFHQ[129]YSVK (SEQ ID NO: 964) | 10 |
| | Oxi(M) | M[147]SQLERN[115]IETIIN[115]TFHQYSVK (SEQ ID NO: 965) | 4 |
| | Oxi(M) | M[147]SQLERN[115]IETIINTFHQ[129]YSVK (SEQ ID NO: 966) | 17 |
| | Oxi(M) | M[147]SQLERN[115]IETIINTFHQYSVK (SEQ ID NO: 967) | 26 |
| | Oxi(M) | M[147]SQLERNIETIIN[115]TFHQ[129]YSVK (SEQ ID NO: 968) | 12 |
| | Oxi(M) | M[147]SQLERNIETIIN[115]TFHQYSVK (SEQ ID NO: 969) | 45 |
| | Oxi(M) | M[147]SQLERNIETIINTFHQ[129]YSVK (SEQ ID NO: 970) | 93 |
| | Oxi(M) | M[147]SQLERNIETIINTFHQYSVK (SEQ ID NO: 971) | 337 |
| | Oxi(M) | Q[111]LSFEEFIM[147]LM[147]AR (SEQ ID NO: 972) | 456 |
| | Oxi(M) | Q[111]LSFEEFIM[147]LMAR (SEQ ID NO: 973) | 58 |
| | Oxi(M) | Q[111]LSFEEFIMLM[147]AR (SEQ ID NO: 974) | 85 |
| | Oxi(M) | Q[129]LSFEEFIM[147]LMAR (SEQ ID NO: 975) | 2 |
| | Oxi(M) | QLSFEEFIM[147]LM[147]AR (SEQ ID NO: 976) | 1453 |
| | Oxi(M) | QLSFEEFIM[147]LMAR (SEQ ID NO: 26) | 2131 |
| | Oxi(M) | QLSFEEFIMLM[147]AR (SEQ ID NO: 977) | 384 |
| | Oxi(M) | VIEHIM[147]EDLDTN[115]ADK (SEQ ID NO: 978) | 208 |
| | Oxi(M) | VIEHIM[147]EDLDTNADK (SEQ ID NO: 979) | 6021 |
| | Oxi(M) | VIEHIM[147]EDLDTNADKQLSFEEFIM[147]LM[147]AR (SEQ ID NO: 980) | 80 |
| | Oxi(M) | VIEHIM[147]EDLDTNADKQLSFEEFIM[147]LMAR (SEQ ID NO: 981) | 28 |
| | Oxi(M) | VIEHIM[147]EDLDTNADKQLSFEEFIMLM[147]AR (SEQ ID NO: 982) | 6 |
| | Oxi(M) | VIEHIM[147]EDLDTNADKQLSFEEFIMLMAR (SEQ ID NO: 983) | 25 |
| | Oxi(M) | VIEHIMEDLDTNADKQLSFEEFIM[147]LM[147]AR (SEQ ID NO: 984) | 10 |
| | Oxi(M) | VIEHIMEDLDTNADKQLSFEEFIM[147]LMAR (SEQ ID NO: 985) | 29 |
| | Oxi(M) | VIEHIMEDLDTNADKQLSFEEFIMLM[147]AR (SEQ ID NO: 986) | 5 |
| | Phospho | MHEGDEGPGHHHKPGLGEGT[181]P (SEQ ID NO: 987) | 929 |
| | Phospho, Oxi(M) | M[147]HEGDEGPGHHHKPGLGEGT[181]P (SEQ ID NO: 988) | 237 |
| SAA1 | Cit | DPNHFR[157]PAGLPEKY (SEQ ID NO: 989) | 1.99 |
| | Cit | FFGHGAEDSLADQAANEWGR[157] (SEQ ID NO: 27) | 9.98 |
| | Cit | GPGGVWAAEAISDAR[157] (SEQ ID NO: 28) | 25 |
| | Cit | R[157]GPGGAWAAEVISDAR[157] (SEQ ID NO: 990) | 1 |
| | Cit | SFFSFLGEAFDGAR[157] (SEQ ID NO: 991) | 14.88 |
| | Cit | SGKDPNHFR[157]PAGLPEKY (SEQ ID NO: 992) | 0.99 |
| SEMG1 | Cit | HLAQHLNNDR[157] (SEQ ID NO: 29) | 14 |
| | Cit | HLGGSQQLLHNKQEGR[157] (SEQ ID NO: 30) | 1 |
| | Cit | R[157]LHYGENGVQK (SEQ ID NO: 993) | 2 |
| | Cit Phospho | GES[167]GQ[129]S[167]T[181]N[115]R[157] (SEQ ID NO: 31) | 1.99 |
| | Phospho | ISYQSSS[167]TEER (SEQ ID NO: 994) | 1.98 |
| TAGLN2 | Cit | GPAYGLSR[157] (SEQ ID NO: 995) | 16 |
| | Cit | IEKQYDADLEQILIQWITTQCR[157] (SEQ ID NO: 996) | 3 |
| | Cit | n[43]ANR[157]GPAYGLSR (SEQ ID NO: 997) | 1 |
| | Cit | NMACVQRTLMNLGGLAVAR[157]DDGLFSGDPNWFPKK (SEQ ID NO: 998) | 1 |
| | Cit | NVIGLQMGTNR[157]GASQAGMTGYGMPRQIL (SEQ ID NO: 999) | 4 |
| | Cit | NVIGLQMGTNRGASQAGMTGYGMPR[157]QIL (SEQ ID NO: 1000) | 4 |
| | Cit | QMEQISQFLQAAER[157] (SEQ ID NO: 1001) | 10 |
| | Cit | QMEQISQFLQAAER[157]YGINTTDIFQTVDLWEGK (SEQ ID NO: 1002) | 4 |
| | Cit | QYDADLEQILIQWITTQCR[157] (SEQ ID NO: 1003) | 1 |
| | Cit | QYDADLEQILIQWITTQCR[157]K (SEQ ID NO: 1004) | 4.97 |
| | Cit | YGINTTDIFQTVDLWEGKNMACVQR[157] (SEQ ID NO: 1005) | 2 |

TABLE 6-continued

PTMs founds in Multiple Human Cohort

| Gene | Modification | modified_peptide | Sum of sc |
|---|---|---|---|
| | Cit Oxi(M) | GASQAGM[147]TGYGM[147]PR[157] (SEQ ID NO: 1006) | 1 |
| | Oxi(M) | GASQAGM[147]TGYGM[147]PR (SEQ ID NO: 1007) | 657.93 |
| | Oxi(M) | GASQAGM[147]TGYGMPR (SEQ ID NO: 1008) | 559.58 |
| | Oxi(M) | GASQAGMTGYGM[147]PR (SEQ ID NO: 1009) | 578.58 |
| | Oxi(M) | IQASTM[147]AFK (SEQ ID NO: 1010) | 170 |
| | Oxi(M) | IQASTM[147]AFKQMEQISQFLQAAER (SEQ ID NO: 1011) | 3 |
| | Oxi(M) | IQASTMAFKQM[147]EQISQFLQAAER (SEQ ID NO: 1012) | 2 |
| | Oxi(M) | KIQASTM[147]AFK (SEQ ID NO: 1013) | 16 |
| | Oxi(M) | N[115]VIGLQM[147]GTNR (SEQ ID NO: 1014) | 2 |
| | Oxi(M) | NFSDNQLQEGKNVIGLQM[147]GTNR (SEQ ID NO: 1015) | 19 |
| | Oxi(M) | NM[147]AC[160]VQR (SEQ ID NO: 1016) | 2 |
| | Oxi(M) | NM[147]AC[228]VQR (SEQ ID NO: 1017) | 2 |
| | Oxi(M) | NM[147]AC[407]VQR (SEQ ID NO: 1018) | 34 |
| | Oxi(M) | NM[147]AC[432]VQR (SEQ ID NO: 1019) | 13 |
| | Oxi(M) | NM[147]ACVQR (SEQ ID NO: 1020) | 38 |
| | Oxi(M) | NM[147]ACVQR[166] (SEQ ID NO: 1021) | 4 |
| | Oxi(M) | NVIGLQM[147]GTN[115]R (SEQ ID NO: 1022) | 1 |
| | Oxi(M) | NVIGLQM[147]GTNR (SEQ ID NO: 1023) | 773 |
| | Oxi(M) | NVIGLQM[147]GTNRGASQAGMTGYGMPR (SEQ ID NO: 1024) | 4 |
| | Oxi(M) | Q[111]M[147]EQ[129]ISQFLQAAER (SEQ ID NO: 1025) | 1 |
| | Oxi(M) | Q[111]M[147]EQISQFLQAAER (SEQ ID NO: 1026) | 188.02 |
| | Oxi(M) | QM[147]EQISQFLQAAER (SEQ ID NO: 1027) | 861.04 |
| | Oxi(M) | QM[147]EQISQFLQAAERYGINTTDIFQ[129]TVDLWEGK (SEQ ID NO: 1028) | 4 |
| | Oxi(M) | QM[147]EQISQFLQAAERYGINTTDIFQTVDLWEGK (SEQ ID NO: 1029) | 4 |
| | Oxi(M) | TLM[147]N[115]LGGLAVAR (SEQ ID NO: 1030) | 2 |
| | Oxi(M) | TLM[147]NLGGLAVAR (SEQ ID NO: 1031) | 1377 |
| | Oxi(M) | TLM[147]NLGGLAVARDDGLFSGDPNWFPKK (SEQ ID NO: 1032) | 6 |
| | Oxi(M) | YGINTTDIFQTVDLWEGKNM[147]ACVQR (SEQ ID NO: 1033) | 2 |
| | Phospho | DGT[181]VLCELINALYPEGQAPVK (SEQ ID NO: 1034) | 22 |
| | Phospho | GPAY[243]GLSR (SEQ ID NO: 1035) | 8 |
| | Phospho | NFS[167]DNQLQEGK (SEQ ID NO: 1036) | 110 |
| | Phospho | S[167]DNQLQEGKNVIGL (SEQ ID NO: 1037) | 2 |
| | Phospho, Oxi(M) | GASQAGM[147]TGY[243]GM[147]PR (SEQ ID NO: 1038) | 35 |
| TGM3 | Oxi(M) | DSATM[147]SLDPEEEAEHPIK (SEQ ID NO: 1039) | 14 |
| | Oxi(M) | EGDVQLNFDM[147]PFIFAEVNADR (SEQ ID NO: 1040) | 5 |
| | Oxi(M) | GLGSNERLEFIVSTGPYPSESAM[147]TK (SEQ ID NO: 1041) | 1 |
| | Oxi(M) | GQNFQVLM[147]IM[147]NK (SEQ ID NO: 1042) | 1.98 |
| | Oxi(M) | LEFIVSTGPYPSESAM[147]TK (SEQ ID NO: 1043) | 85.89 |
| | Oxi(M) | LKPNTPFAATSSM[147]GLETEEQEPSIIGK (SEQ ID NO: 1044) | 17 |
| | Oxi(M) | M[147]DVTDKYKYPEGSDQER (SEQ ID NO: 1045) | 2 |
| | Oxi(M) | NLSVDVYYDPM[147]GNPLDK (SEQ ID NO: 1046) | 49 |
| | Oxi(M) | VAGM[147]LAVGK (SEQ ID NO: 1047) | 10 |
| | Oxi(M) | YTM[147]ALQIFSQGGISSVK (SEQ ID NO: 1048) | 1 |
| TNNI3 | Cit | ESLDLR[157]AHLK (SEQ ID NO: 1049) | 2 |
| | Cit | ISADAMMQALLGAR[157] (SEQ ID NO: 1050) | 1 |
| | Cit | NIDALSGMEGR[157]K (SEQ ID NO: 1051) | 1 |
| | Cit Oxi(M) | ISADAMM[147]QALLGAR[157] (SEQ ID NO: 1052) | 1 |
| | Oxi(M) | ISADAM[147]M[147]QALLGAR (SEQ ID NO: 1053) | 497.92 |
| | Oxi(M) | ISADAM[147]MQALLGAR (SEQ ID NO: 1054) | 332.82 |
| | Oxi(M) | ISADAMM[147]QALLGAR (SEQ ID NO: 1055) | 142.87 |
| | Oxi(M) | ISAVAM[147]M[147]QALLGAR (SEQ ID NO: 1056) | 30 |
| | Oxi(M) | ISAVAM[147]MQALLGAR (SEQ ID NO: 1057) | 87 |
| | Oxi(M) | ISAVAMM[147]QALLGAR (SEQ ID NO: 1058) | 10 |
| | Oxi(M) | KNIDALSGM[147]EGR (SEQ ID NO: 1059) | 132 |
| | Oxi(M) | KNIDALSGM[147]EGRK (SEQ ID NO: 1060) | 6 |
| | Oxi(M) | NIDALSGM[147]EGR (SEQ ID NO: 1061) | 1802.62 |
| | Oxi(M) | NIDALSGM[147]EGRK (SEQ ID NO: 1062) | 95 |
| | Oxi(M) | VRISADAM[147]M[147]QALLGAR (SEQ ID NO: 1063) | 37 |
| | Oxi(M) | VRISADAM[147]MQALLGAR (SEQ ID NO: 1064) | 38.88 |
| | Oxi(M) | VRISADAMM[147]QALLGAR (SEQ ID NO: 1065) | 8 |
| | Phospho | AKES[167]LDLR (SEQ ID NO: 1066) | 103 |
| | Phospho | n[43]ADG5[167]SDAAR (SEQ ID NO: 1067) | 5 |
| | Phospho | n[43]ADG55[167]DAAR (SEQ ID NO: 1068) | 3 |
| | Phospho | NIDALS[167]GMEGR (SEQ ID NO: 1069) | 98 |
| | Phospho | T[181]LLLQ[129]IAK (SEQ ID NO: 1070) | 2 |
| | Phospho | T[181]LLLQIAK (SEQ ID NO: 1071) | 3 |
| | Phospho, Oxi(M) | N[115]IDALS[167]GM[147]EGR (SEQ ID NO: 1072) | 2 |

TABLE 6-continued

PTMs founds in Multiple Human Cohort

| Gene | Modification | modified_peptide | Sum of sc |
|------|--------------|------------------|-----------|
|  | Phospho, Oxi(M) | NIDALS[167]GM[147]EGR (SEQ ID NO: 1073) | 97 |
| VASP | Cit | ATVMLYDDGNKR[157] (SEQ ID NO: 1074) | 1 |
|  | Cit | DESAN[115]QEEPEAR[157]VPAQSESVR[157]R[157]PWEK (SEQ ID NO: 1075) | 1 |
|  | Cit | DESANQEEPEAR[157]VPAQ[129]SESVRR[157]PWEK (SEQ ID NO: 1076) | 4 |
|  | Cit | DESANQEEPEAR[157]VPAQSESVR[157]R[157]PWEK (SEQ ID NO: 1077) | 4 |
|  | Cit | DESANQEEPEAR[157]VPAQSESVRR[157]PWEK (SEQ ID NO: 1078) | 2 |
|  | Cit | MQPDQQVVINCAIVR[157] (SEQ ID NO: 1079) | 3 |
|  | Cit | VKEEI1EAFVQELR[157] (SEQ ID NO: 1080) | 4 |
|  | Cit | VPAQSESVR[157] (SEQ ID NO: 1081) | 1 |
|  | Cit | VQIYHNPTANSFR[157] (SEQ ID NO: 1082) | 1 |
|  | Cit | YNQATPNFHQWR[157] (SEQ ID NO: 1083) | 1 |
|  | Oxi(M) | ATVM[147]LYDDGNK (SEQ ID NO: 1084) | 1.98 |
|  | Oxi(M) | ATVM[147]LYDDGNKR (SEQ ID NO: 1085) | 9.9 |
|  | Oxi(M) | M[147]QPDQQVVINCAIVR (SEQ ID NO: 1086) | 1 |
|  | Oxi(M) | SGGGGLM[147]EEM[147]NAM[147]LAR (SEQ ID NO: 1087) | 13 |
|  | Oxi(M) | SGGGGLM[147]EEM[147]NAMLAR (SEQ ID NO: 1088) | 1 |
|  | Oxi(M) | SGGGGLMEEMNAM[147]LAR (SEQ ID NO: 1089) | 5 |
|  | Phospho | KVS[167]KQEEASGGPTAPK (SEQ ID NO: 1090) | 21 |
|  | Phospho | MKS[167]SSSVTTSETQPC[160]TPSSSDYSDLQR (SEQ ID NO: 1091) | 6 |
|  | Phospho | MKS[167]SSSVITSETQPCTPSSSDYSDLQR (SEQ ID NO: 1092) | 6 |
|  | Phospho | MKSS[167]SSVTTSETQPC[160]TPSSSDYSDLQR (SEQ ID NO: 1093) | 4 |
|  | Phospho | MKSS[167]SSVTTSETQPCTPSSSDYSDLQR (SEQ ID NO: 1094) | 5 |
|  | Phospho | MKSSS[167]SVTTSETQPCTPSSSDYSDLQR (SEQ ID NO: 1095) | 1 |
|  | Phospho | MKSSSS[167]VTTSETQPC[160]TPSSSDYSDLQR (SEQ ID NO: 1096) | 1 |
|  | Phospho | MKSSSS[167]VTTSETQPCTPSSSDYSDLQR (SEQ ID NO: 1097) | 3 |
|  | Phospho | QEEAS[167]GGPTAPKAES[167]GRSGGGGLMEEMNAMLARR (SEQ ID NO: 1098) | 1 |
| VCAM1 | Oxi(M) | GETILENIEFLEDTDM[147]K (SEQ ID NO: 1099) | 16.18 |
|  | Oxi(M) | LHIDEM[147]DSVPTVR (SEQ ID NO: 1100) | 3.99 |
|  | Oxi(M) | M[147]EDSGVYLCEGINQAGR (SEQ ID NO: 1101) | 0.99 |
|  | Oxi(M) | SLEM[147]TFIPTIEDTGK (SEQ ID NO: 1102) | 8.01 |
|  | Oxi(M) | VTNEGTTSTLTM[147]NPVSFGNEHSYLCTATCESR (SEQ ID NO: 1103) | 3.96 |
|  | Phospho | VGS[167]QLRSLTLDVQGRENNK (SEQ ID NO: 1104) | 3 |
|  | Phospho | VGSQLRS[167]LTLDVQGRENNK (SEQ ID NO: 1105) | 3 |
|  | Phospho, Oxi(M) | LDNGNLQHLSGNAT[181]LTLIAM[147]R (SEQ ID NO: 1106) | 1.02 |

A. Exemplary Markers

Exostosin-like 2. IPI ID: IPI00002732; UniProtKB/Swiss-Prot ID: Q9UBQ6. Sequence length: 330 aa, molecular weight: 37466 Da. Subcellular location: Endoplasmic reticulum membrane; Single-pass type II membrane protein, Processed exostosin-like 2: Secreted. Note: A soluble form is found in the serum.

Function: Glycosyltransferase required for the biosynthesis of heparan-sulfate and responsible for the alternating addition of beta-1-4-linked glucuronic acid (GlcA) and alpha-14-linked N-acetylglucosamine (GlcNAc) units to nascent heparan sulfate chains.

```
Sequence: >sp|Q9UBQ6|EXTL2_HUMAN Exostosin-like 2
OS = Homo sapiens GN = EXTL2 PE = 1 SV = 1
                                  (SEQ ID NO: 1107)
MRCCHICKLPGRVMGIRVLRLSLVVILVLLLVAGALTALLPSVKEDKML

MLRREIKSQGKSTMDSFTLIMQTYNRTDLLLKLLNHYQAVPNLHKVIVV

WNNIGEKAPDELWNSLGPHPIPVIFKQQTANRMRNRLQVFPELETNAVL

MVDDDTLISTPDLVFAFSVWQQFPDQIVGFVPRKHVSTSSGIYSYGSFE

MQAPGSGNGDQYSMVLIGASFFNSKYLELFQRQPAAVHALIDDTQNCDD

IAMNFIIAKHIGKTSGIFVKPVNMDNLEKETNSGYSGMWHRAEHALQRS

YCINKLVNIYDSMPLRYSNIMISQFGFPYANYKRKI.
```

| Feature key | Position(s) | Length | Description |
|-------------|-------------|--------|-------------|
| Chain | ?-330 |  | Processed exostosin-like 2/FTID = PRO_0000296227 |
| Chain | 1-330 | 330 | Exostosin-like 2/FTID = PRO_0000149655 |
| Glycosylation | 74 | 1 | N-linked (GlcNAc . . .) |
| Disulfide bond | 243 ↔ 296 |  | By similarity |

Alternative names: Alpha-1,4-N-acetylhexosaminyltransferase EXTL2; Alpha-GalNAcT EXTL2; EXT-related protein 2; Glucuronyl-galactosyl-proteoglycan 4-alpha-N-acetylglucosaminyltransferase Cleaved into the following chain: Processed exostosin-like 2

ADP-ribosyl cyclase 1. UniProtKB/Swiss-Prot: CD38_HUMAN, P28907 (See protein sequence). Recommended Name: ADP-ribosyl cyclase 1. Size: 300 amino acids; 34328 Da. Subcellular location: Membrane; Single-pass type II membrane protein.

Developmental stage: Preferentially expressed at both early and late stages of the B and T-cell maturation. It is also detected on erythroid and myeloid progenitors in bone marrow, where the level of surface expression was shown to decrease during differentiation of blast-forming unit E to colony-forming unit E Function Summary: Synthesizes cyclic ADP-ribose, a second messenger for glucose-induced insulin secretion. Also has cADPr hydrolase activity. Also moonlights as a receptor in cells of the immune system.

Catalytic activity: NAD(+)+H(2)O=ADP-ribose+nicotinamide. Enzyme regulation: ATP inhibits the hydrolyzing activity.

Protein S100-A12. Protein names: Protein S100-A12. IPI ID: IPI00218131. UniProtKB/Swiss-Prot ID: P80511. Sequence length: 92 aa, molecular weight: 10575 Da.

Function: Calcitermin possesses antifungal activity against *C. albicans* and is also active against *E. coli* and *P. aeruginosa* but not *L. monocytogenes* and *S. aureus*. Binds calcium, zinc and copper. Presence of zinc increases the affinity for calcium. Plays an important role in the inflammatory response. Interaction with AGER on endothelium, mononuclear phagocytes, and lymphocytes triggers cellular activation, with generation of key proinflammatory mediators By similarity.

```
Sequence: >sp|P80511|S10AC_HUMAN Protein S100-A12
OS = Homo sapiens GN = S100A12 PE = 1 SV = 2
                                      (SEQ ID NO: 1117)
MTKLEEHLEGIVNIFHQYSVRKGHFDTLSKGELKQLLTKELANTIKNIK

DKAVIDEIFQGLDANQDEQVDFQEFISLVAIALKAAHYHTHKE.
```

Alternative name(s): CGRP; Calcium-binding protein in amniotic fluid 1 (Short name=CAAF1); Calgranulin-C (Short name=CAGC); Extracellular newly identified RAGE-binding protein (Short name=EN-RAGE); Neutrophil S100 protein; S100 calcium-binding protein A12.

Cysteine and glycine-rich protein 1. Protein names: Cysteine and glycine-rich protein 1. IPI ID: IPI00442073. UniProtKB/Swiss-Prot ID: P21291 Sequence length: 193 aa, molecular weight: 20567 Da. Subcellular location: Nucleus. Function: Could play a role in neuronal development.

```
Sequence: >sp|P21291|CSRP1_HUMAN Cysteine and
glycine-rich protein 1 OS = Homo sapiens GN =
CSRP1 PE = 1 SV = 3
                                      (SEQ ID NO: 1118)
MPNWGGGKKCGVCQKTVYFAEEVQCEGNSFHKSCFLCMVCKKNLDSTTV

AVHGEEIYCKSCYGKKYGPKGYGYGQGAGTLSTDKGESLGIKHEEAPGH

RPTTNPNASKFAQKIGGSERCPRCSQAVYAAEKVIGAGKSWHKACFRCA

KCGKGLESTTLADKDGEIYCKGCYAKNFGPKGFGFGQGAGALVHSE.
```

Alternative name(s): Cysteine-rich protein 1 (Short name=CRP; CRP1).

Transmembrane protease serine 4. Protein names: Transmembrane protease serine 4 (EC=3.4.21.-). IPI ID: IPI00221211(isoform 1) (Q9NRS4); IPI00411324(isoform 2) (Q9NRS4-2); IPI00554650(isoform 3) (Q9NRS4-3). Sequence length: 437aa, 432aa, 435aa. molecular weight: 48246 Da, 47686 Da, 48005 Da. Subcellular location: Membrane; Single-pass type II membrane protein. Function: Probable protease. Seems to be capable of activating ENaC.

```
Sequence: >sp|Q9NRS4|TMPS4_HUMAN Transmembrane
protease serine 4
OS = Homo sapiens GN = TMPRSS4 PE = 2 SV = 2
                                      (SEQ ID NO: 1128)
MLQDPDSDQPLNSLDVKPLRKPRIPMETFRKVGIPIIIALLSLASIIIV

VVLIKVILDKYYFLCGQPLHFIPRKQLCDGELDCPLGEDEEHCVKSFPE

GPAVAVRLSKDRSTLQVLDSATGNWFSACFDNFTEALAETACRQMGYSS

KPTFRAVEIGPDQDLDVVEITENSQELRMRNSSGPCLSGSLVSLHCLAC

GKSLKTPRVVGVEEASVDSWPWQVSIQYDKQHVCGGSILDPHWVLTAAH

CFRKHTDVFNWKVRAGSDKLGSFPSLAVAKIIIEFNPMYPKDNDIALM

KLQFPLTFSGTVRPICLPFFDEELTPATPLWIIGWGFTKQNGGKMSDIL

LQASVQVIDSTRCNADDAYQGEVTEKMMCAGIPEGGVDTCQGDSGGPLM

YQSDQWHVVGIVSWGYGCGGPSTPGVYTKVSAYLNWIYNVWKAEL.

>sp|Q9NRS4-2|TMPS4_HUMAN Isoform 2 of
Transmembrane protease serine 4
OS = Homo sapiens GN = TMPRSS4
                                      (SEQ ID NO: 1126)
MLQDPDSDQPLNSLDVKPLRKPRIPMETFRKVGIPIIIALLSLASIIIV

VVLIKVILDKYYFLCGQPLHFIPRKQLCDGELDCPLGEDEEHCVKSFPE

GPAVAVRLSKDRSTLQVLDSATGNWFSACFDNFTEALAETACRQMGYSR

AVEIGPDQDLDVVEITENSQELRMRNSSGPCLSGSLVSLHCLACGKSLK

TPRVVGVEEASVDSWPWQVSIQYDKQHVCGGSILDPHWVLTAAHCFRKH

TDVFNWKVRAGSDKLGSFPSLAVAKIIIEFNPMYPKDNDIALMKLQFP

LTFSGTVRPICLPFFDEELTPATPLWIIGWGFTKQNGGKMSDILLQASV

QVIDSTRCNADDAYQGEVTEKMMCAGIPEGGVDTCQGDSGGPLMYQSDQ

WHVVGIVSWGYGCGGPSTPGVYTKVSAYLNWIYNVWKAEL.

>sp|Q9NRS4-3|TMPS4_HUMAN Isoform 3 of
Transmembrane protease serine 4
OS = Homo sapiens GN = TMPRSS4
                                      (SEQ ID NO: 1127)
MDPDSDQPLNSLDVKPLRKPRIPMETFRKVGIPIIIALLSLASIIIVVV

LIKVILDKYYFLCGQPLHFIPRKQLCDGELDCPLGEDEEHCVKSFPEGP

AVAVRLSKDRSTLQVLDSATGNWFSACFDNFTEALAETACRQMGYSSKP

TFRAVEIGPDQDLDVVEITENSQELRMRNSSGPCLSGSLVSLHCLACGK

SLKTPRVVGVEEASVDSWPWQVSIQYDKQHVCGGSILDPHWVLTAAHCF

RKHTDVFNWKVRAGSDKLGSFPSLAVAKIIIEFNPMYPKDNDIALMKL

QFPLTFSGTVRPICLPFFDEELTPATPLWIIGWGFTKQNGGKMSDILLQ

ASVQVIDSTRCNADDAYQGEVTEKMMCAGIPEGGVDTCQGDSGGPLMYQ

SDQWHVVGIVSWGYGCGGPSTPGVYTKVSAYLNWIYNVWKAEL.
```

Alternative name(s): Channel-activating protease 2 (Short name=CAPH2); Membrane-type serine protease 2 (Short name=MT-SP2).

B. Data

The validation study was done with a human valve replacement cohort with 19 subjects and a label-free spectra counting mass spectrometry based method.

1). Method:

The present inventors have identified a number of protein markers for cardiac (myocardial) injury (including non-necrotic cardiac (myocardial) ischemia injury) using a valve replacement model. In this study, ischemia was induced by coronary blockage: subjects undergoing valve replacement surgery exhibited ischemia because of blood loss during the procedure. This procedure mimics naturally occurring events in which ischemia is induced by coronary blood vessel blockage. Coronary sinus serum samples were obtained from individuals (n=19) that underwent aortic valve replacements immediately prior to (T0) and 5 minutes following (T1) removal of the individual from coronary pump bypass. The operative technique was similar in all patients, with an average aortic cross clamp time of 55.6 minutes. For each individual, cross clamp times (time of ischemia), circulating cTnI for T0, T1 and delta TnI (data now shown). The lower limit of detection for the cTnI assay was 0.005 ng/mL.

Each plasma sample was analyzed essentially according to Sheng et al. [11]. Briefly, 20 mg plasma was partitioned using affinity (IgY) chromatography comprising antibodies raised against the top abundant plasma proteins (IgY2-LC10 (Beckman Coulter, # A24355), resulting in approximately 750 mg of depleted sample present in the flow through. 200 mg were separated based on hydrophobicity using 1-dimensional reversed phase high performance liquid chromatography (C18300_A 250_4:6 mm RP column (Phenomenex)). Proteins were separated using 15 minute isocratic gradient at 20% B followed by a linear A/B gradient of 2.0% B/minute (total of 38 analysis) where solvent A was composed of 0.08% aqueous triuoroacetic acid and solvent B consisted of 0.08% triuoroacetic acid in acetonitrile. Fractions were collected, dried down, then resolubilized in neutralizing buffer compatible for tryptic digestion and stored at −80° C. until use. At that time of MS analysis, tryptic digestion was carried out as described in [13].

Each digested fraction was analyzed using the LTQ Orbitrap LC MS/MS instrument (ThermoFinnigan, San Jose, Calif.) using an Agilent 1200 nano-liquid chromatographic system (Agilent, Santa Clara, Calif.) as previously described [II] in duplicate (total of 1216 MS runs). Briefly, peptides were dissolved in 6 μL of buffer A (4% acetonitrile in water with 0.1% formic acid). Samples (3 mL) were loaded onto a 75 mm 10 cm BioBasic C18 column (New Objective, Woburn, Mass.) and eluted using a linear A/B gradient comprising of 5% to 60% B (0.1% formic acid in 90% acetonitrile/water) over 60 minutes. The mass spectrometer was operated in data-dependent mode on randomized patient samples; every FT-MS scan (survey 350-2000 Da) was followed by MS/MS scans of the 5 most abundant ions.

Raw MS data was converted to m/zXML format and searched using the X!Tandem algorithm (version 2009.10.01.1) [14] with the k-score plug-in against the concatenated target/decoy human Uniprot database [15] as of Oct. 22, 2010. The search was performed with the following parameters: Trypsin-based digestion with a maximum of two missed cleavages; parent-ion mass tolerance of 0.1 Da; fragment-ion mass tolerance of 1.0 Da; a modification of cysteine carbamidomethylation and variable states for methionine oxidation, serine phosphorylation, threonine phosphorylation, tyrosine phosphorylation, tryptophan oxidation, methionine dioxidation, tryptophan dioxidation, asparagine deamidation and glutamine deamidation. Software msConvert v2.0.1905 from ProteoWizard was used for peaklist generation; the searched database contained 221992 entries (including decoys, 110996 excluding them).

2). Cardiac Injury and Cardiac Injury Related Markers:

The results from the search were subsequently processed through PeptideProphet for pep tide validation using the Trans Proteomic Pipeline, version v4.4, rev 1. iProphet was used to further improve the identification probabilities, and ProteinProphet was then used to infer protein identifications from the resulting combined peptide list and perform grouping of ambiguous hits. The resulting list includes proteins identified by one or more unique peptides even if found only once and in a single sample. Only those proteins identified by doubly and triply charged ions were considered for the analysis during the initial analysis. Furthermore, the CD-HIT [19] clustering tool was used to cluster highly similar proteins with sequence homology above 90% over the entire protein.

The results of the studies are summarized in Table 7 and Table 8. The results were calculated based on spectra counting ratio of T6/T0. Spectra counting ratio >2 is considered to be significant for that particular individual. There are 29 proteins that are found to have induced expression in the blood by supply ischemia (valve replacement procedure) and they are classified as class I cardiac injury markers. These 29 proteins are ischemia induced proteins, their expression in the blood increased only after supply ischemia. The study shows that 29 proteins are referred to herein as "Class I" markers as they released into blood only after injury (Table III). They are: Exostosin-like 2, cDNA FLI53119 (highly similar to ADP-ribosyl cyclase 1 (EC3.2.2.5), Protein S100-A12, Cysteine and glycine-rich protein 1, Isoform 2 of Transmembrane protease serine 4, Transgelin-2, Profilin-1, Matrix metalloproteinase-9, Protein S100-A4, Histone H1.5, Properdin, Vasodilator-stimulated phosphoprotein, Myosin-7, Myosin-6, MHC class I antigen (Fragment), CD5 antigen-like, Cystatin-A, Cathepsin L1, Dopamine beta-hydroxylase, Histone H2A.Z, Prolactin-inducible protein, Isoform VCAM-6D of Vascular cell adhesion protein 1, Caspase-14, Regulator of G-protein signaling 19, Cathelicidin antimicrobial peptide, Desmoglein-1, Protein-glutamine gammaglutamyltransferase E, Bleomycin hydrolase, Protein FAM136A.

TABLE 7

29 Class I Proteins, Cardiac Injury Markers

| Acc IDs (All) | Protein Description (All) | Protein Length (All) Amino acid | Total Patients | Total Patients Found | SC Ratio (>=2) | SC Ratio (<2) | % SC > 2 in found patients | % SC < 2 in found patients | Bio-marker Class |
|---|---|---|---|---|---|---|---|---|---|
| Q9UBQ6 | Exostosin-like 2 | 330 | 19 | 16 | 16 | 0 | 100% | 0% | I |
| B4E006 | cDNA FU53119, highly similar to ADP-ribosyl cyclase 1 (EC 3.2.2.5) | 160 | 19 | 8 | 8 | 0 | 100% | 0% | I |
| P80511 | Protein S100-Al2 | 92 | 19 | 7 | 7 | 0 | 100% | 0% | I |
| P21291 | Cysteine and glycine-rich protein 1 | 193 | 19 | 4 | 4 | 0 | 100% | 0% | I |
| Q9NRS4-2 | Isoform 2 of Transmembrane protease serine 4 | 432 | 19 | 4 | 4 | 0 | 100% | 0% | I |

TABLE 7-continued

29 Class I Proteins, Cardiac Injury Markers

| Acc IDs (All) | Protein Description (All) | Protein Length (All) Amino acid | Total Patients | Total Patients Found | SC Ratio (>=2) | SC Ratio (<2) | % SC > 2 in found patients | % SC < 2 in found patients | Bio-marker Class |
|---|---|---|---|---|---|---|---|---|---|
| P37802 | Transgelin-2 | 199 | 19 | 3 | 3 | 0 | 100% | 0% | I |
| P07737 | Profilin-1 | 140 | 19 | 3 | 3 | 0 | 100% | 0% | I |
| P14780 | Matrix metalloproteinase-9 | 707 | 19 | 2 | 2 | 0 | 100% | 0% | I |
| P26447 | Protein S100-A4 | 101 | 19 | 2 | 2 | 0 | 100% | 0% | I |
| P16401 | Histone H1.5 | 226 | 19 | 2 | 2 | 0 | 100% | 0% | I |
| P27918 | Properdin | 469 | 19 | 2 | 2 | 0 | 100% | 0% | I |
| P50552 | Vasodilator-stimulated phosphoprotein | 380 | 19 | 2 | 2 | 0 | 100% | 0% | I |
| P12883 | Myosin-7 | 1935 | 19 | 1 | 1 | 0 | 100% | 0% | I |
| P13533 | Myosin-6 | 1939 | 19 | 1 | 1 | 0 | 100% | 0% | I |
| D7NNN8 | MHC class I antigen (Fragment) | 181 | 19 | 1 | 1 | 0 | 100% | 0% | I |
| O43866 | CD5 antigen-like | 347 | 19 | 1 | 1 | 0 | 100% | 0% | I |
| P01040 | Cystatin-A | 98 | 19 | 1 | 1 | 0 | 100% | 0% | I |
| P07711 | Cathepsin 11 | 333 | 19 | 1 | 1 | 0 | 100% | 0% | I |
| P09172 | Dopamine beta-hydroxylase | 617 | 19 | 1 | 1 | 0 | 100% | 0% | I |
| P0C0S5 | Histone H2A.Z | 128 | 19 | 1 | 1 | 0 | 100% | 0% | I |
| P12273 | Prolactin-inducible protein | 146 | 19 | 1 | 1 | 0 | 100% | 0% | I |
| P19320-2 | Isoform VCAM-6D of Vascular cell adhesion protein 1 | 647 | 19 | 1 | 1 | 0 | 100% | 0% | I |
| P31944 | Caspase-14 | 242 | 19 | 1 | 1 | 0 | 100% | 0% | I |
| P49795 | Regulator of G-protein signaling 19 | 217 | 19 | 1 | 1 | 0 | 100% | 0% | I |
| P49913 | Cathelicidin antimicrobial peptide | 170 | 19 | 1 | 1 | 0 | 100% | 0% | I |
| Q02413 | Desmoglein-1 | 1049 | 19 | 1 | 1 | 0 | 100% | 0% | I |
| Q08188 | Protein-glutamine gamma-glutamyltransferase E | 693 | 19 | 1 | 1 | 0 | 100% | 0% | I |
| Q13867 | Bleomycin hydrolase | 455 | 19 | 1 | 1 | 0 | 100% | 0% | I |
| Q96C01 | Protein FAM136A | 138 | 19 | 1 | 1 | 0 | 100% | 0.0 | I |

Another 28 proteins were referred as "Class II" markers, as they are elevated in >60% of valve replacement cohort (Table IV). The second 21 proteins are classified as cardiac injury class II markers (Table IV). They are Protein S100-A6, Isoform H14 of Myeloperoxidase, Isoform 2 of Neutrophil gelatinase-associated lipocalin, Beta-Ala-His dipeptidase, Catalase, Desmoplakin, Glyceraldehyde-3-phosphate dehydrogenase, lg, gamma-2 chain C region, Myoglobin, Protein S100-A9, Semenogelin-1, Chromogranin-A, Histone H4, Histone H1.4, Protein S100-A7, Apolipoprotein A-II, Carbonic anhydrase 1, Lactoferrin, Insulin-like, growth factor-binding protein 1, cDNA FU75188, highly similar to Homo sapiens matrilin 2, transcript variant 2, mRNA, Peroxiredoxin-2. These proteins present in the blood prior to supply ischemia (valve replacement procedure). Their expression was elevated post cardiac injury induced by supply ischemia. They are cardiac injury related proteins.

TABLE 8

29 Proteins Elevated Expression Found In All Patients (Spectra Counting Ratio > 2)

| Acc IDs (All) | Protein Description (All) | Protein Length (All) Amino acid | Total Patients | Total Patients Found | SC Ratio (>=2) | SC Ratio (<2) | % SC > 2 in found patients | % SC < 2 in found patients | Bio-marker Class |
|---|---|---|---|---|---|---|---|---|---|
| Q9UBQ6; B4DNZ2; C9IYF5; C9JEG3; D3DT60; Q05DH5; Q49A43; Q8IYF4; Q8N8F1 | Exostosin-like 2 | 330 {Q9UB06}; 317 {B4DNZ2}; 117 {C9IYF5}; 266 {C9JEG3}; 330 {D3DT60}; 331 {Q05DH5}; 33... [TRUNCATED!] | 19 | 16 | 16 | 0 | 100% | 0% | I |
| B4E006 | cDNA FU53119, highly similar to ADP-ribosyl cyclase 1 (EC 3.2.2.5) | 160 {B4E006} | 19 | 8 | 8 | 0 | 100% | 0% | I |
| P80511 | Protein S100-A12 | 92 {P80511} | 19 | 7 | 7 | 0 | 100% | 0% | I |
| P21291; A8K268; B4DY28; B4E2T4; Q59EQ5; Q5U0J2; Q6ZMS3; Q9BTA4 | Cysteine and glycine-rich protein 1 | 193 {P21291}; 193 {A8K268}; 187 {B4DY28}; 140 {B4E2T4}; 159 {Q59EQ5}; 193 {Q5U0J2}; 19... [TRUNCATED!] | 19 | 4 | 4 | 0 | 100% | 0% | I |
| Q9NRS4-2; Q9NRS4-3; Q9NRS4; A8K2U6; A8MYM4; B7Z8X1; | Isoform 2 of Transmembrane protease serine 4 | 432 {Q9NRS4-2}; 435 {Q9NRS4-3}; 437 {Q9NRS4}; 335 {A8K2U6}; | 19 | 4 | 4 | 0 | 100% | 0% | I |

TABLE 8-continued

29 Proteins Elevated Expression Found In All Patients (Spectra Counting Ratio > 2)

| Acc IDs (All) | Protein Description (All) | Protein Length (All) Amino acid | Total Patients | Total Patients Found | SC Ratio (>=2) | SC Ratio (<2) | % SC > 2 in found patients | % SC < 2 in found patients | Bio-marker Class |
|---|---|---|---|---|---|---|---|---|---|
| B7Z900 | | 437 {A8MYM4}; 435 {B7Z8X1}... [TRUNCATED!] | | | | | | | |
| P37802 | Transgelin-2 | 199 {P37802} | 19 | 3 | 3 | 0 | 100% | 0% | I |
| P07737; Q53Y4 | Profilin-1 | 140 {P07737}; 140 {Q53Y44} | 19 | 3 | 3 | 0 | 100% | 0% | I |
| P14780; B7Z74 | Matrix metalloproteinase-9 | 707 {P14780}; 594 {B7Z747} | 19 | 2 | 2 | 0 | 100% | 0% | I |
| P26447; D3DV46 | Protein S100-A4 | 101 {P26447}; 101 {D3DV46} | 19 | 2 | 2 | 0 | 100% | 0% | I |
| P16401 | Histone H1.5 | 226 {P16401} | 19 | 2 | 2 | 0 | 100% | 0% | I |
| P27918 | Properdin | 469 {P27918} | 19 | 2 | 2 | 0 | 100% | 0% | I |
| P50552 | Vasodilator-stimulated phosphoprotein | 380 {P50552} | 19 | 2 | 2 | 0 | 100% | 0% | I |
| P12883 | Myosin-6 | 1935 {P12883} | 19 | 1 | 1 | 0 | 100% | 0% | I |
| P13533; D9YZU2 | Myosin-7 | 1939 {P13533}; 1939 {D9YZU2} | 19 | 1 | 1 | 0 | 100% | 0% | I |
| D7NNN8; D7NNP3; Q05G04 | MHC class I antigen (Fragment) | 181 {D7NNN8}; 181 {D7NNP3}; 181 {Q05G04} | 19 | 1 | 1 | 0 | 100% | 0% | I |
| O43866 | CD5 antigen-like | 347 {O43866} | 19 | 1 | 1 | 0 | 100% | 0% | I |
| P01040; C9J0E4; Q6IB90 | Cystatin-A | 98 {P01040}; 63 {C9J0E4}; 98 {Q6IB90} | 19 | 1 | 1 | 0 | 100% | 0% | I |
| P07711; A5PLM9; B3KQK4; Q5T8F0 | Cathepsin L1 | 333 {P07711}; 333 {A5PLM9}; 333 {B3KQK4}; 225 {Q5T8F0} | 19 | 1 | 1 | 0 | 100% | 0% | I |
| P09172 | Dopamine beta-hydroxylase | 617 {P09172} | 19 | 1 | 1 | 0 | 100% | 0% | I |
| P0C0S5; Q71UI9; A6NN01; C9J0D1 | Histone H2A.Z | 128 {P0C0S5}; 128 {Q71UI9}; 114 {A6NN01}; 122 {C9J0D1} | 19 | 1 | 1 | 0 | 100% | 0% | I |
| P12273 | Prolactin-inducible protein | 146 {P12273} | 19 | 1 | 1 | 0 | 100% | 0% | I |
| P19320-2; P19320 B4D5S4; Q53FL7 | Isoform VCAM-6D of Vascular cell adhesion protein 1 | 647 {P19320-2}; 739 {P19320}; 677 {B4DKS4}; 739 {Q53FL7} | 19 | 1 | 1 | 0 | 100% | 0% | I |
| P31944; B2CIS9 | Caspase-14 | 242 {P31944}; 242 {B2CIS9} | 19 | 1 | 1 | 0 | 100% | 0% | I |
| P49795; B4DP94; Q6I9S5 | Regulator of G-protein signaling 19 | 217 {P49795}; 195 {B4DP94}; 217 {Q6I9S5} | 19 | 1 | 1 | 0 | 100% | 0% | I |
| P49913 | Cathelicidin antimicrobial peptide | 170 {P49913} | 19 | 1 | 1 | 0 | 100% | 0% | I |
| Q02413 | Desmoglein-1 | 1049 {Q02413} | 19 | 1 | 1 | 0 | 100% | 0% | I |
| Q08188; B4DQ50; D3DVX1 | Protein-glutamine gamma-glutamyltransferase E | 693 {Q08188}; 533 {B4DQ50}; 693 {D3DVX1} | 19 | 1 | 1 | 0 | 100% | 0% | I |
| Q13867 | Bleomycin hydrolase | 455 {Q13867} | 19 | 1 | 1 | 0 | 100% | 0% | I |
| Q96C01; B0AZT6; C9JF51 | Protein FAM136A | 138 {Q96C01}; 107 {B0AZT6}; 163 {C9JF51} | 19 | 1 | 1 | 0 | 100% | 0.0 | I |

Cardiac Injury Markers Validation with a MRM assays. SRM (Single Reaction Monitoring) analysis utilizes a triple quadrupole type of instrument to select and analyze a specific analyte (such as a peptide or a small molecule). In SRM analysis, the specificity depends on multiple mass analyzers (mass filters): the first quadrupole is to select the desired parent ion; the third quadrupole is to monitor the (one or more) fragment ion(s). The fragment ion(s) is generated through collisional induced dissociation in the second quadrupole. Therefore, SRM is a highly specific detection/monitoring method with low background interference. When multiple parent ions are monitored in a single MS run, this type of analysis is known as MRM (Multiple Reaction Monitoring). Using MRM analysis, multiple proteins and multiple regions (signature peptides) of a protein can be monitored in a single MS run. MRM is rapidly evolving as an alternative to multiplex immunoassays and is reproducible. MRM eliminates the need for developing immunoassays for an analyte while providing absolute quantification for the specific protein(s) within complex protein mixtures such as serum or plasma. Prior to MRM analysis, proteins present in biofluids (such as plasma or urine) are initially cleaved usually with an enzyme (typically trypsin) although chemical methods can also be used to generate a complex peptide mixture. The peptide mixture is often extracted with a solid phase (such as C18 chromatography) to remove any interference (such as salt) prior to applying to a LC system coupled to a mass spectrometer. In general, there are two approaches in quantification of target proteins and their representative peptides in biological fluids using MRM: (i) absolute quantification with stable isotope labeled peptides as internal standards, and (ii) relative quantification with signal intensities of specific transitions(also known as label free quantification). In the first approach, the peptides are synthesized and labeled with a heavy isotope that will shift the mass of the peptide higher than the endogenous peptide, and a known quantity of this labeled peptide is spiked into the samples. After signal intensities of specific MRM transitions of both labeled peptides and matched endogenous peptides obtained, the quantification is achieved by comparing the relative intensity of samples with that of spiked isotopically labeled standard peptide. For label-free quantification, the quantification is based on relative intensities of specific MRM transitions. In all assays, each peptide and each analyte must perform in a reproducible and accurate manner.

Using isotope labeled heavy peptide as internal standards, we have developed MRM assay for 18 cardiac injury proteins and cardiac injury related proteins (list in the Table 9).

TABLE 9

MRM Assays Built for Cardiac Injury Markers Class I and Class II

| Acc IDs (All) | Protein Description (All) | MRM | Cardiac injury class |
|---|---|---|---|
| Q9UBQ6; B4DNZ2; C9IYF5; C9JEG3; D3DT60; Q05DH5; Q49A43; Q8IYF4; Q8N8F1 | Exostosin-like 2 | built | I |
| B4E006 | cDNA FLJ53119, highly similar to ADP-ribosyl cyclase 1 (EC 3.2.2.5) | built | I |
| P80511 | Protein S100-A12 | built | I |
| P21291; A8K268; B4DY28; B4E2T4; Q59EQ5; Q5U0J2; Q6ZMS3; Q9BTA4 | Cystein and glycine-rich protein 1 | built | I |
| Q9NRS4-2; Q9NRS4-3; Q9NRS4; A8K2U6; A8MYM4; B7Z8X1; B7Z900 | Isoform 2 of Transmembrane protease serine 4 | built | I |
| P37802 | Transgelin-2 | | I |
| P07737; Q53Y44 | Profilin-1 | | I |
| P14780; B7Z747 | Matrix metalloproteinase-9 | built | I |
| P25447; D3DV46 | Protein S100-A4 | built | I |
| P16401 | Histone H1.5 | | I |
| P27918 | Properdin | | I |
| P50552 | Vasodilator-stimulated phosphoprotein | | I |
| P12883 | Myosin-7 | | I |
| P13533; D9YZU2 | Myosin-6 | | I |
| D7NNN8; D7NNP3; Q05G04 | MHC class I antigen (Fragment) | | I |
| O43866 | CD5 antigen-like | | I |
| P01040; C9JDE4; Q6IB90 | Cystatin-A | | I |
| P07711; A5PLM9; B3KQK4; Q5T8F0 | Cathepsin L1 | | I |
| P09172 | Dopamine beta-hydroxylase | | I |
| P0C0S5; Q71UI9; A6NN01; C9J0D1 | Histone H2A.Z | | I |
| P12273 | Prolactin-inducible protein | | I |
| P19320-2; P19320; B4DKS4; Q53FL7 | Isoform VCAM-6D of Vascular cell adhesion protein 1 | | I |
| P31944; B2CIS9 | Caspase-14 | | I |
| P49795; B4DP94; Q6I9S5 | Regulator of G-protein signaling 19 | | I |
| P49913 | Cathelicidin antimicrobial peptide | | I |
| Q02413 | Desmoglein-1 | | I |
| Q08188; B4DQ50; D3DVX1 | Protein-glutamine gamma-glutamyltransferase E | | I |
| Q13867 | Bleomycin hydrolase | | I |
| Q96C01; B0AZT6; C9JF51 | Protein FAM136A | | I |
| P06703; D3DV39 | Protein S100-A6 | built | II |
| P05164-2; P05164-3; P05164 | Isoform H14 of Myeloperoxidase | | II |
| P80188-2; P80188; B2ZDQ1 | Isoform 2 of Neutrophil gelatinase-associated lipocalin | built | II |
| Q96KN2; A8K1K1; B4E180 | Beta-Ala-Hisdipeptidase | built | II |
| P04040; D3DR07 | Catalase | built | II |
| P15924 | Desmoplakin | | II |
| P04406; Q2TSD0 | Glyceraldehyde-3-phosphate dehydrogenase | | II |
| P01859 | Ig gamma-2 chain C region | | II |
| P02144; B2RA67 | Myoglobin | | II |
| P06702; D3DV36 | Protein S100-A9 | built | II |
| P04279 | Semenogelin-1 | | II |
| P10645 | Chromogranin-A | | II |
| P62805; B2R4R0; Q0VAS5 | Histone H4 | | II |
| P10412; P16402; P16403; A3R0T7; A3R0T8; A8K4I2; B2R984; Q4VB24 | Histone H1.4 | | II |
| P31151 | Protein S100-A7 | built | II |
| P02652 | Apolipoprotein A-II | built | II |
| P00915 | Carbonic anhydrase 1 | built | II |
| Q2TUW9 | Lactoferrin | built | II |

TABLE 9-continued

MRM Assays Built for Cardiac Injury Markers Class I and Class II

| Acc IDs (All) | Protein Description (All) | MRM | Cardiac injury class |
|---|---|---|---|
| P08833; C1K3N3; C9JXF9; D3DVL9; Q6PEY6 | Insulin-like growth factor-binding protein 1 | built | II |
| A8K106 | cDNA FLJ75188, highly similar to Homo sapiens matrilin 2, transcript variant 2, mRNA | | II |
| P32119; B4DF70 | Peroxiredoxin-2 | built | II |

4.) Verification of Cardiac Injury Markers in Different Cohorts with MRM Analysis.

Valve replacement cohort. S100A9, PRD-2, Lactoferrin, EMC and Lumican levels were measured with plasma samples from the valve replacement cohort. The selected time points of T1, T7 and T9 from all 19 patients' venous plasma were baseline (T), 30 minutes (T7) and 120 (T9) minutes post Cardiopulmonary Bypass (CPB). The results demonstrate that expression of S100A9, Lactoferrin and Peroxiredoxin were elevated 2-20 fold in CPB patients under going valve replacement procedure (post cardiac injury).

Figure 3A:
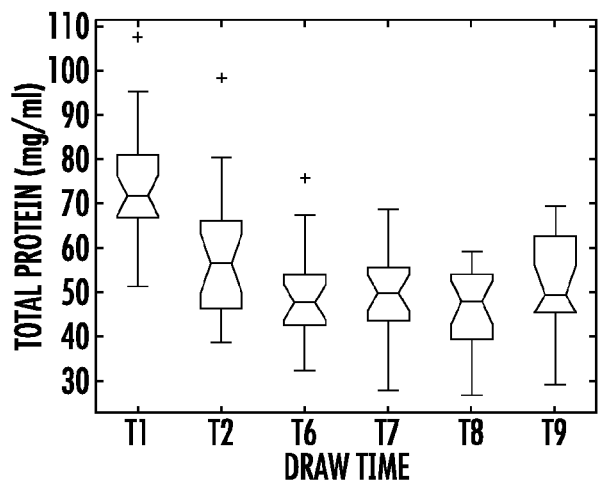
FIG. 3A-3L. Additional markers total protein, sVCAM, sICAM, TnI, TNFa, SAA, NTproBNP, IL-8, IL-10, IFNg, GM-CSF, and CRP also measured with antibody based simplex or multiplexed analysis.
Figure 3B:
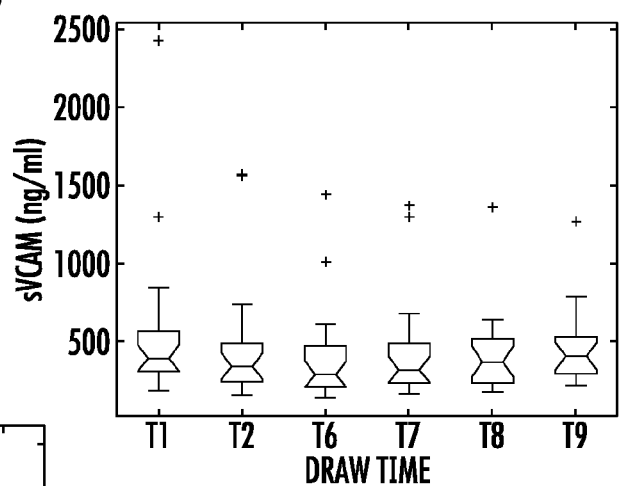
Figure 3C:
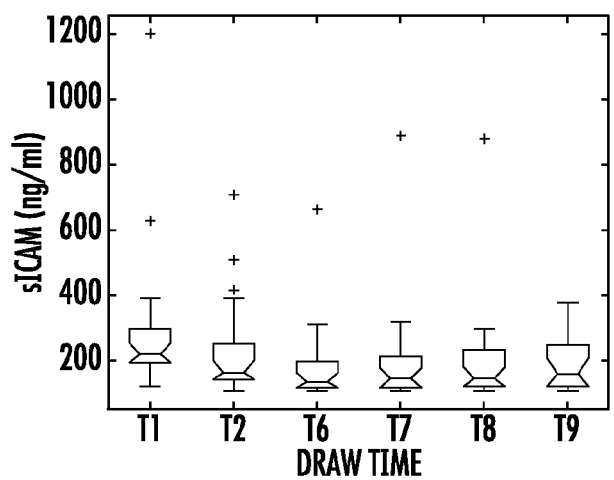
Figure 3D:
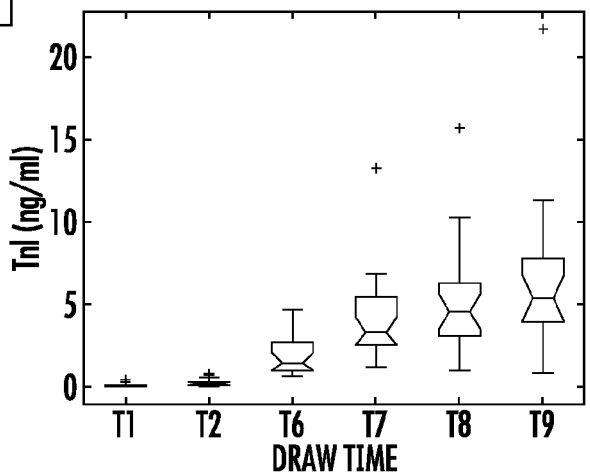
Figure 3E:
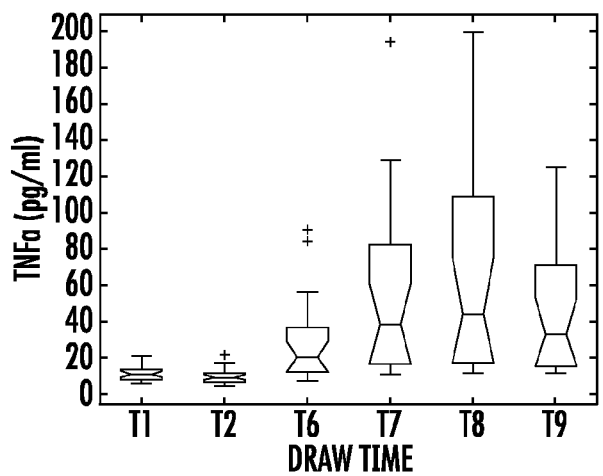
Figure 3F:
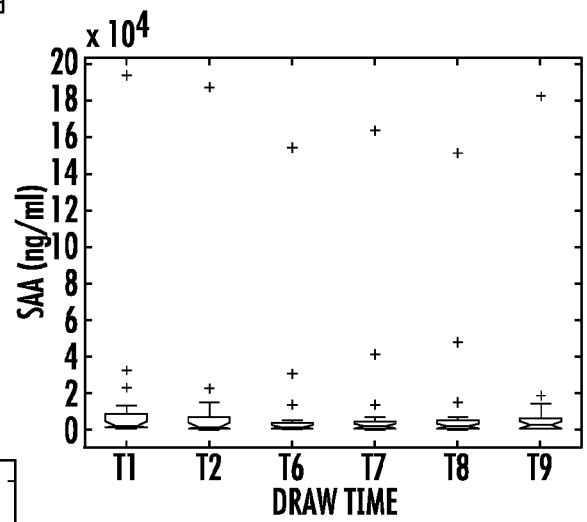
Figure 3G:
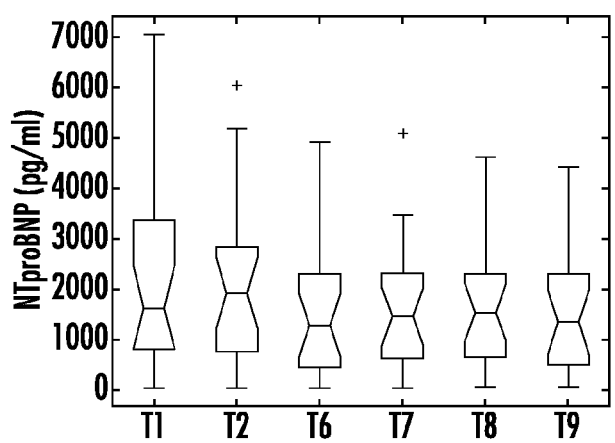
Figure 3H:
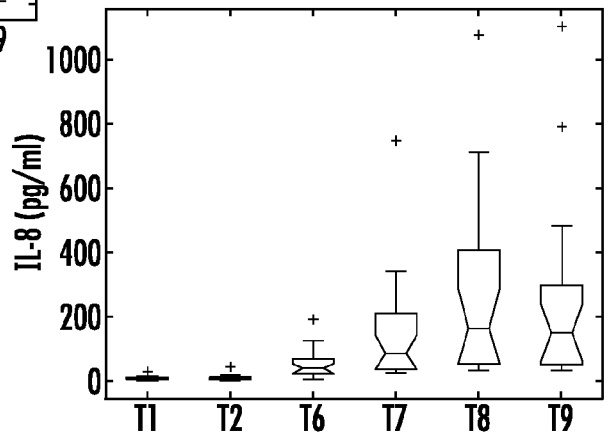
Figure 3I:
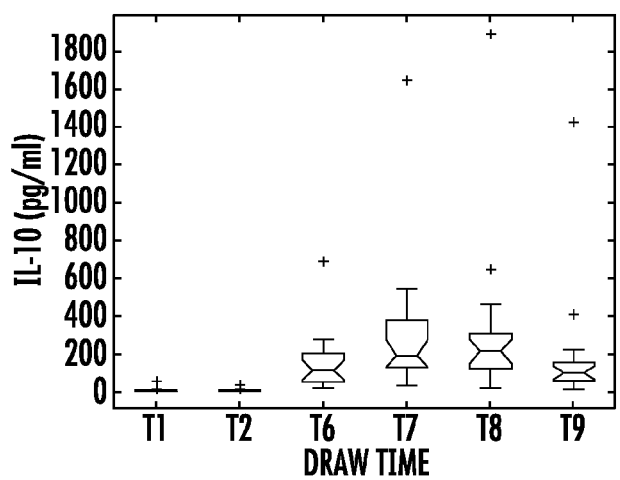
Figure 3J:
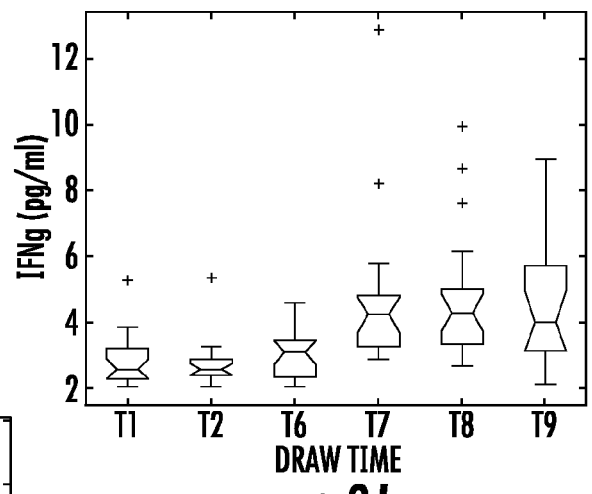
Figure 3K:
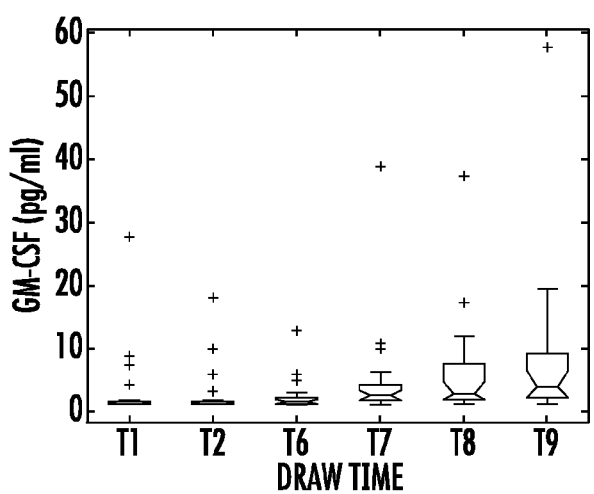
Figure 3L:
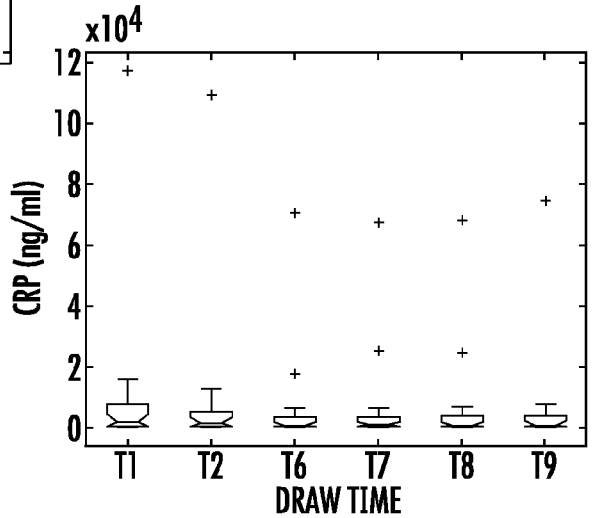
Figure 4:
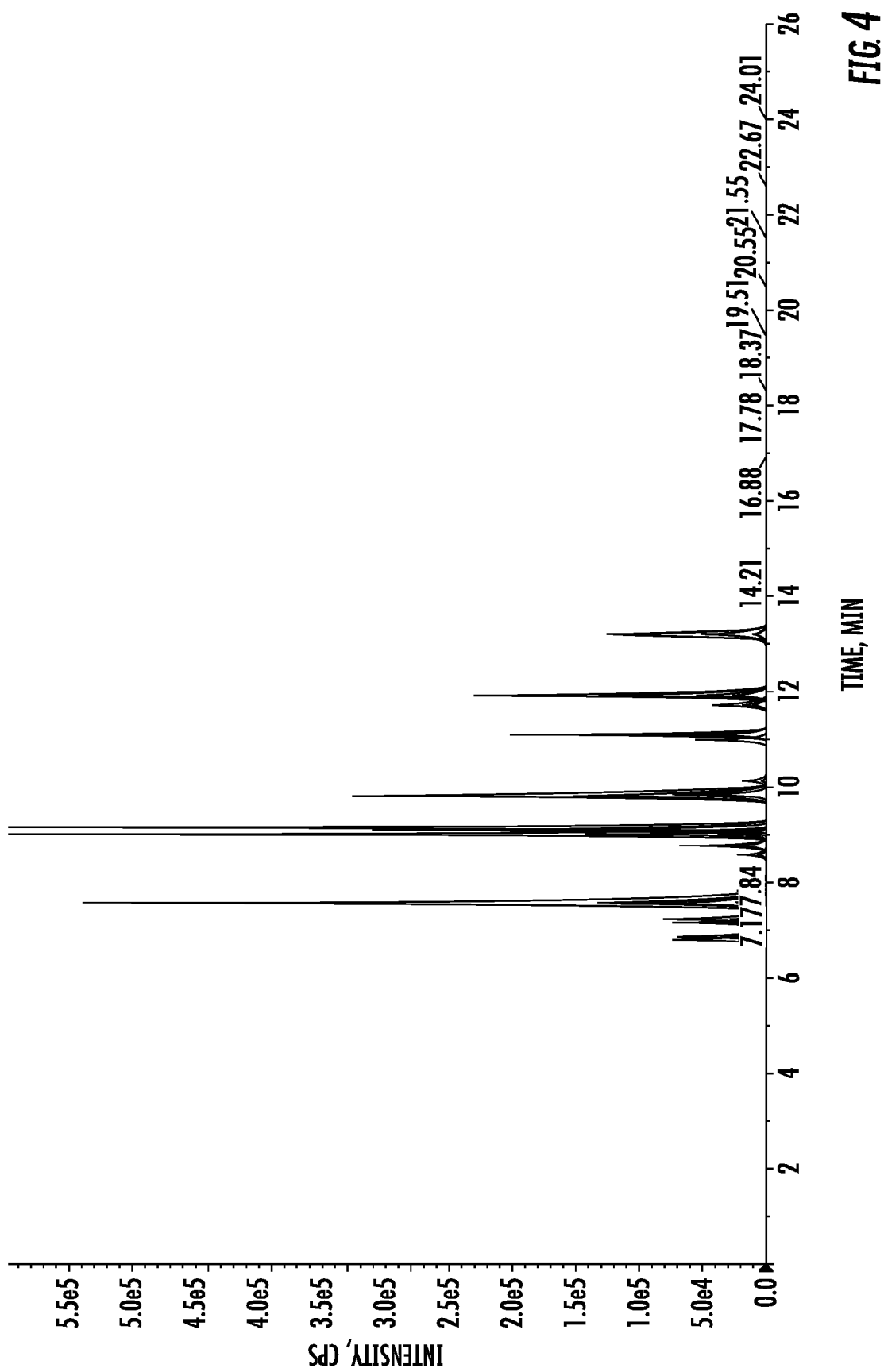
FIG. 4. A representative of MS response, extracted ion chromatograms over time, the overall chromatogram of all specified peptides for each of 8 proteins (ANG, Extracellular matrix protein for Long palate, lung and nasal epithelium carcinoma-1, lactotransferrin, Lumican, S100A9, Peroxiredoxin and beta-gal of MRM of Example 2.
Figure 5:
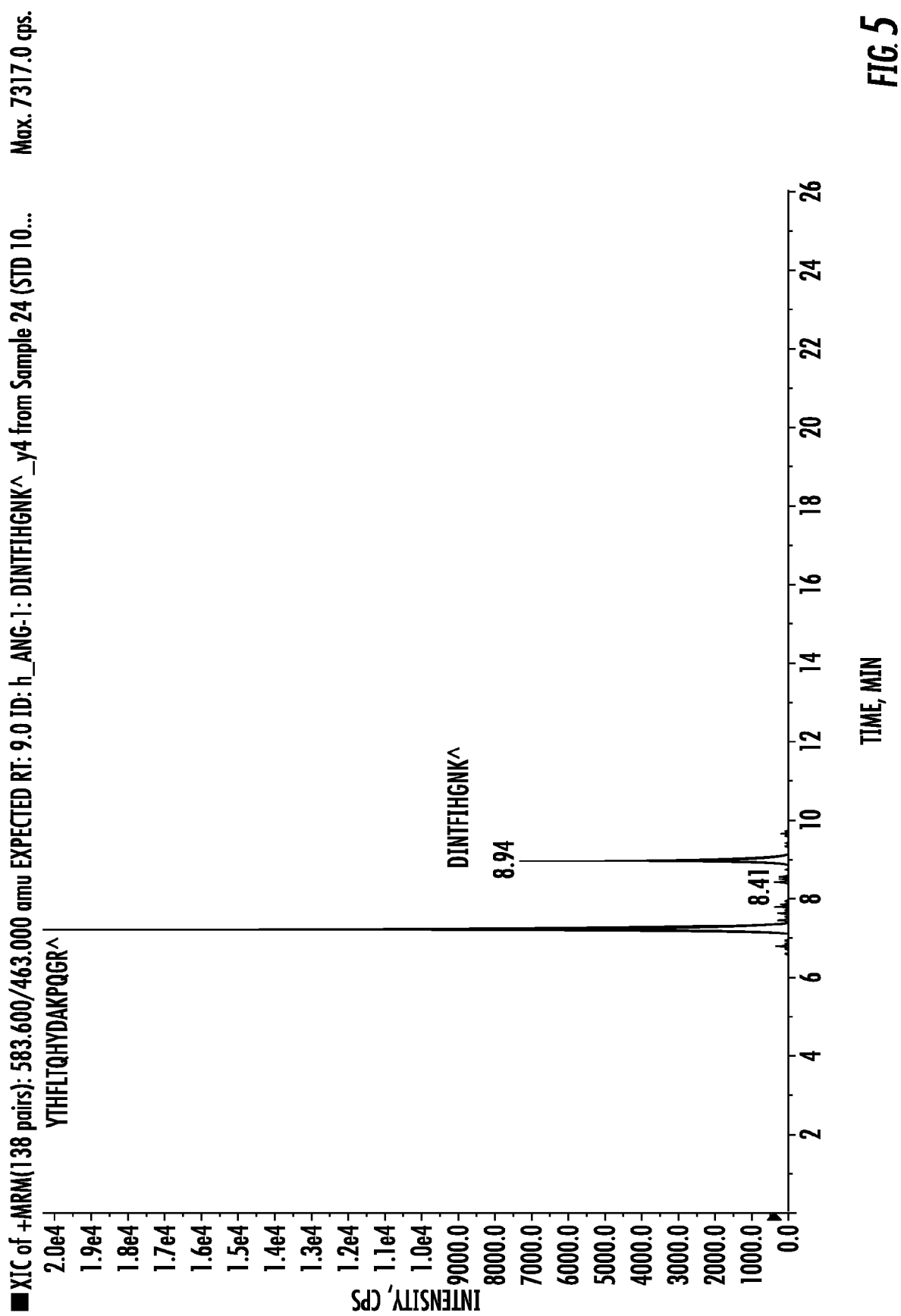
FIG. 5. Extracted ion chromatogram of 2 peptides for FIH protein. Each peak represents multiple transitions of specific peptide as labeled.
Figure 6:
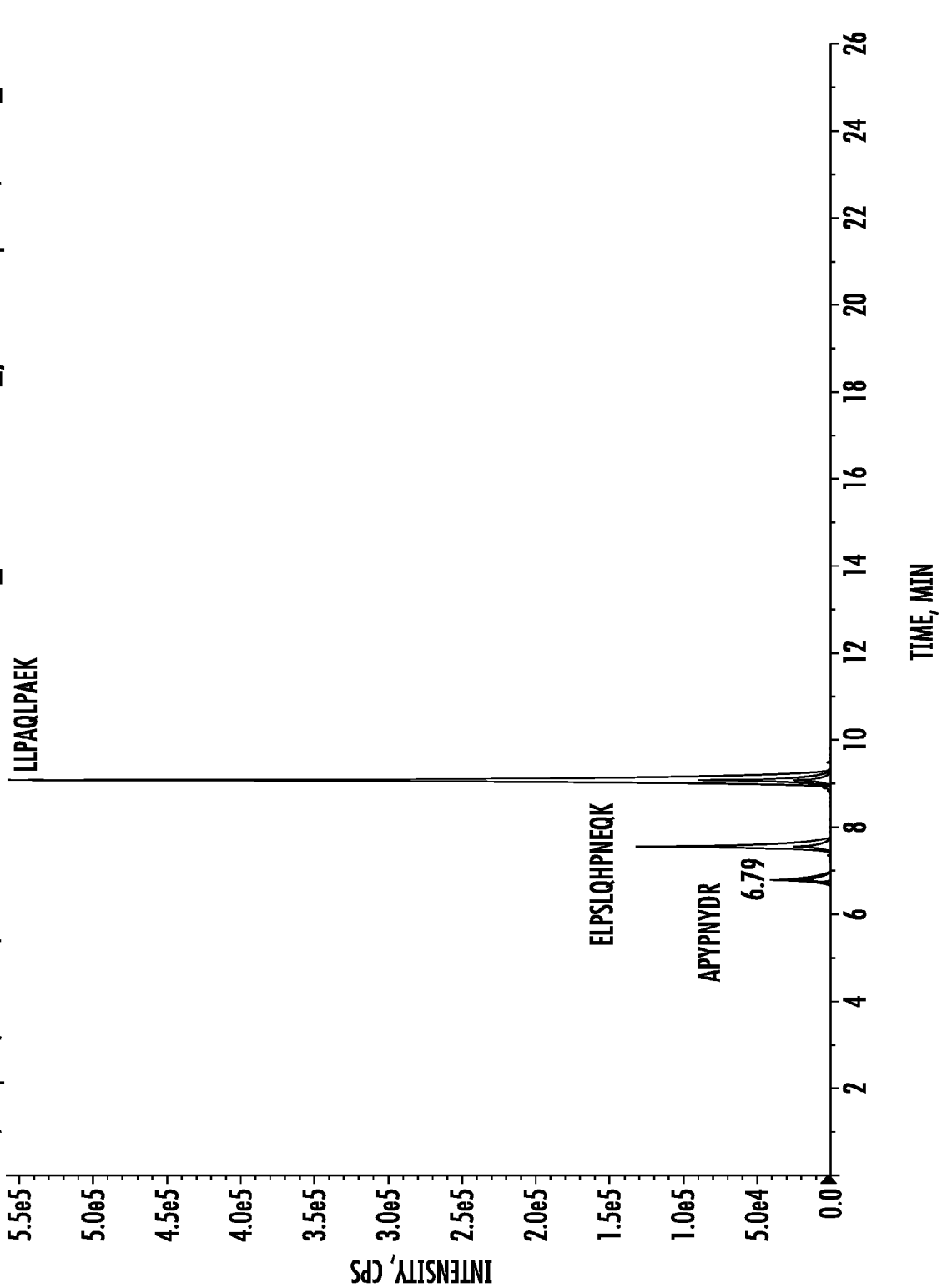
FIG. 6. Extracted ion chromatogram of 3 peptides for Extracellular matrix protein. Each peak represents multiple transitions of specific peptide as labeled.
Figure 7:
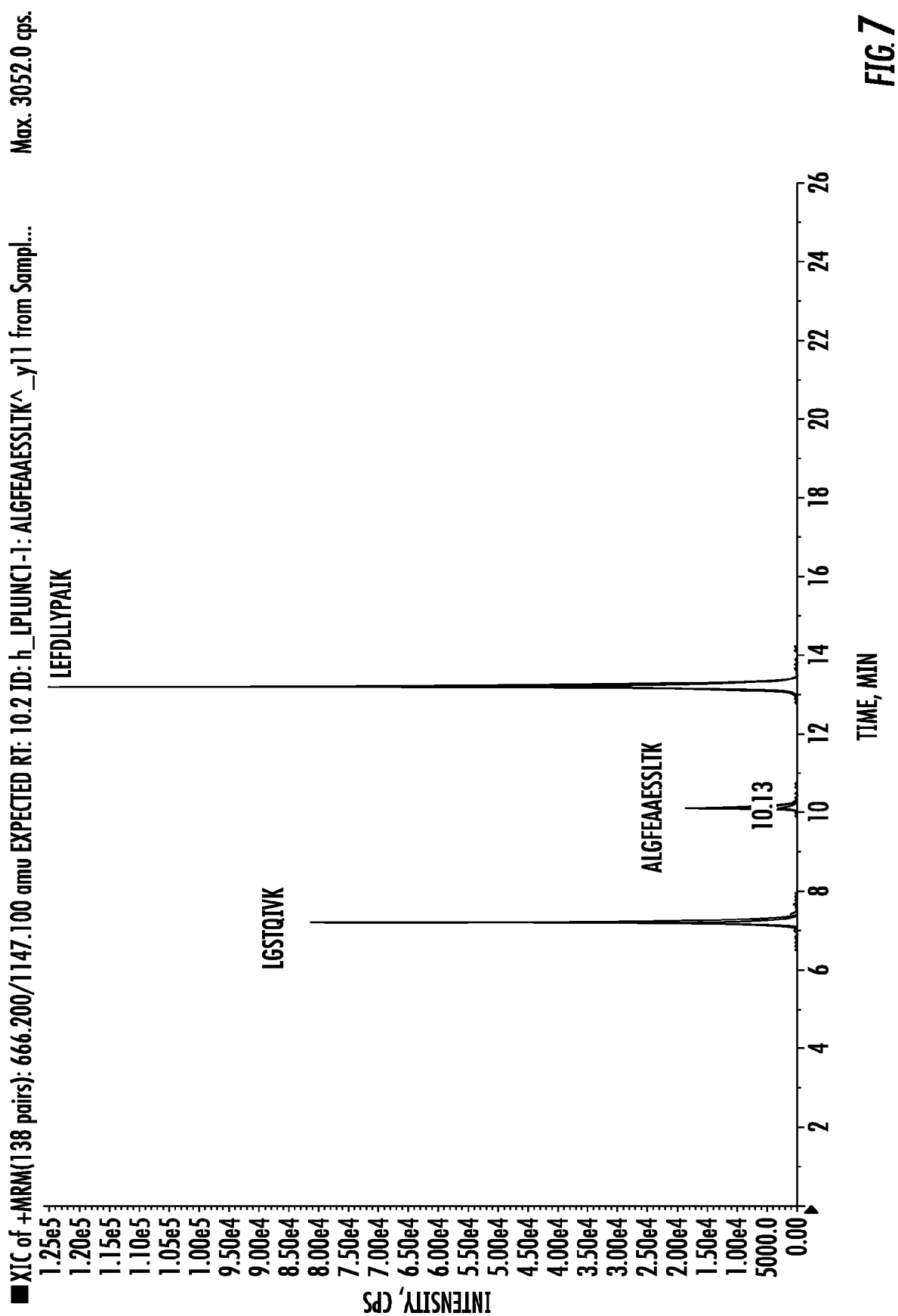
FIG. 7. Extracted ion chromatogram of 3 peptides for Long palate, lung and nasal epithelium carcinoma-1-three peptides. Each peak represents multiple transitions of specific peptide as labeled.
Figure 8:
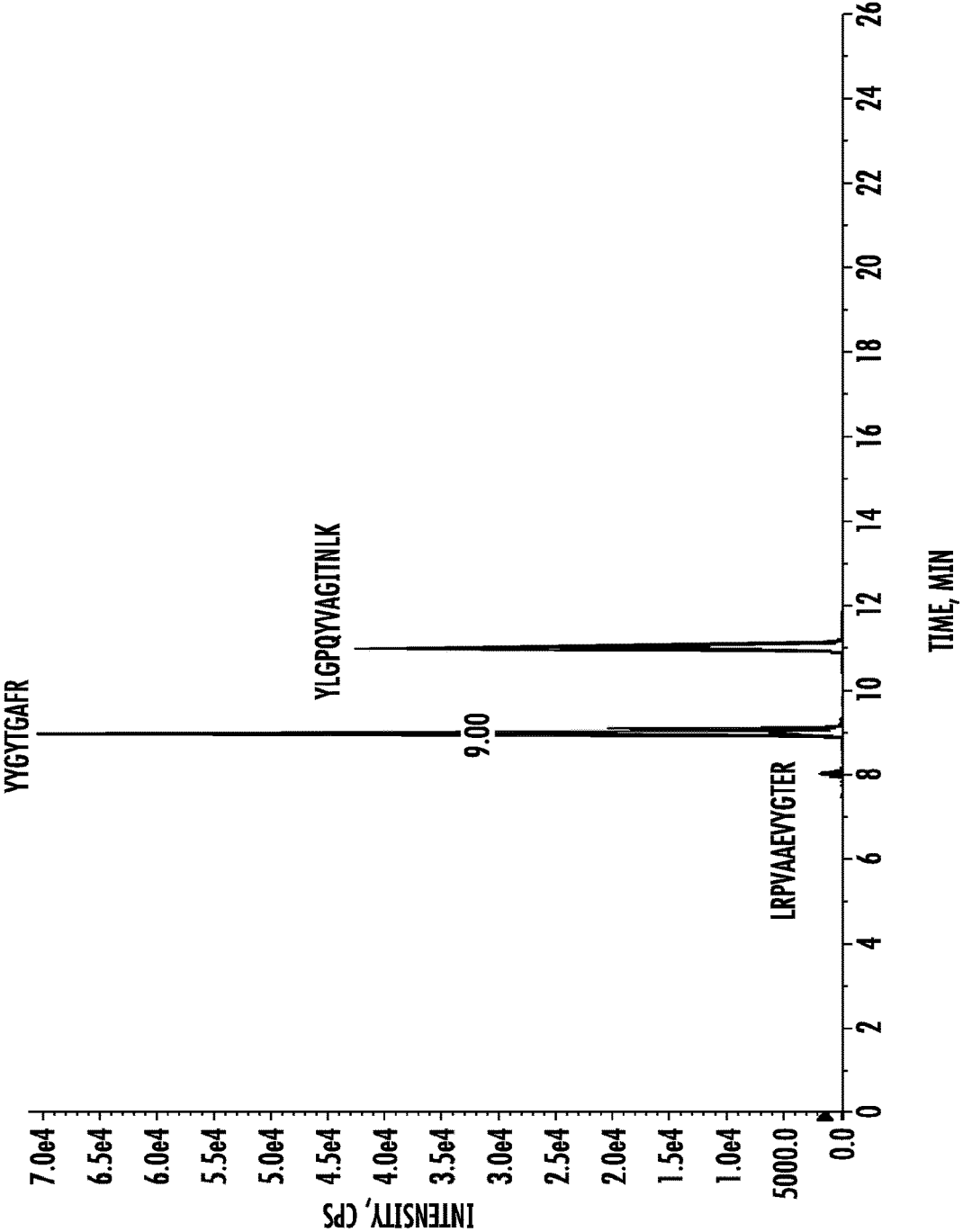
FIG. 8. Extracted ion chromatogram of 3 peptides for lactotransferrin. Each peak represents multiple transitions of specific peptide as labeled.
Figure 9:
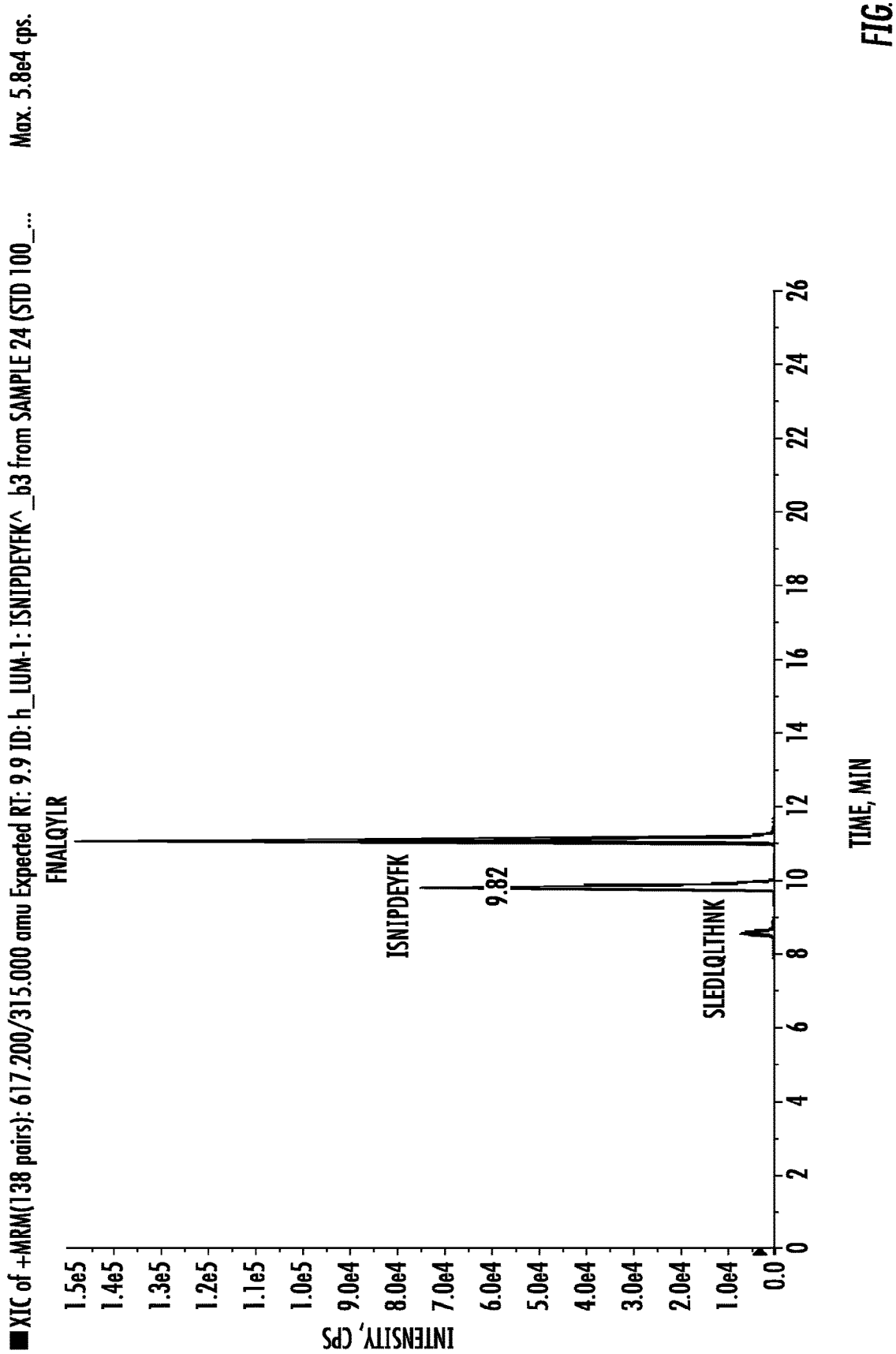
FIG. 9. Extracted ion chromatogram of 3 peptides for Lumican. Each peak represents multiple transitions of specific peptide as labeled.
Figure 10:
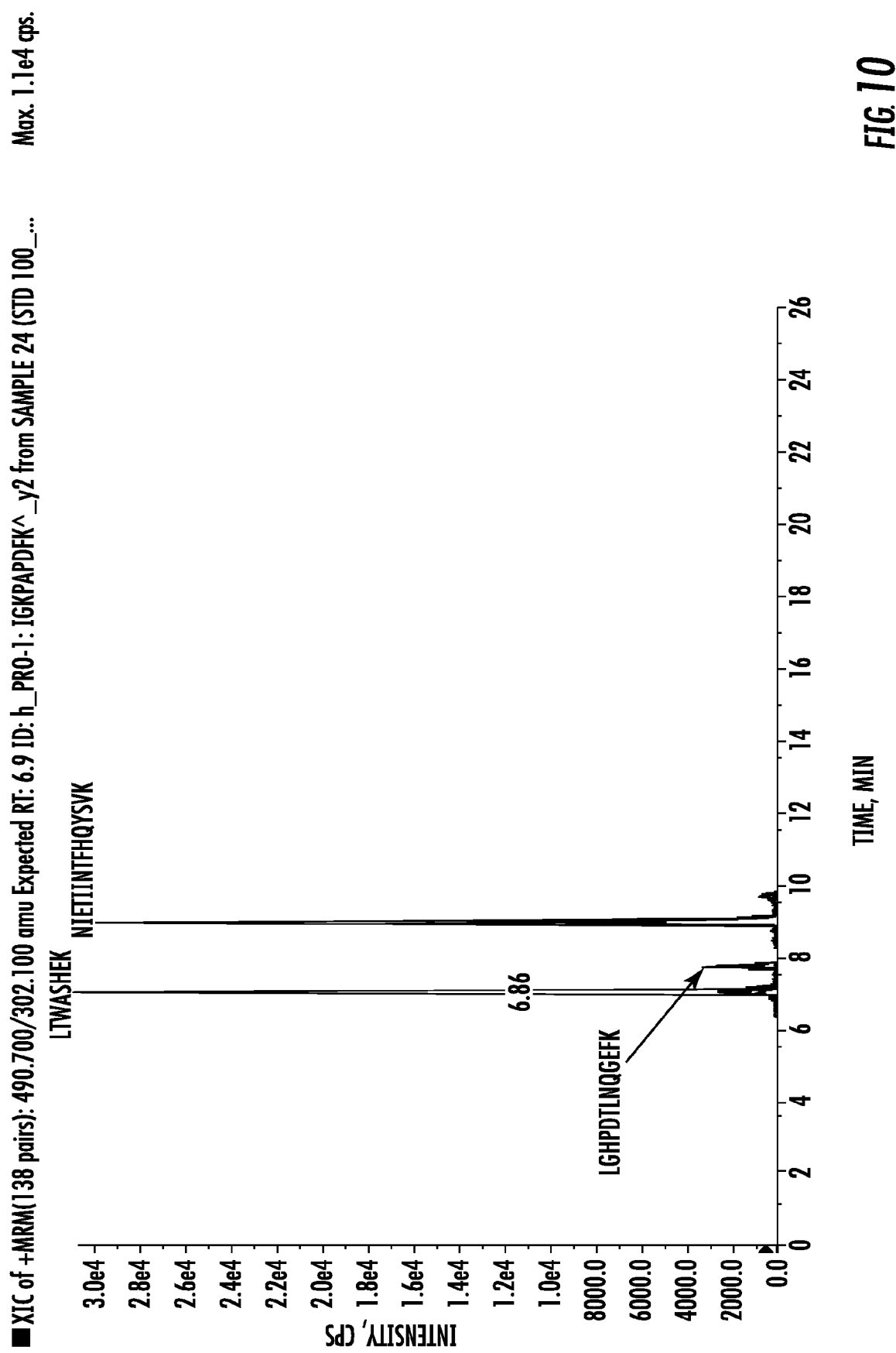
FIG. 10. Extracted ion chromatogram of 3 peptides for S100A9. Each peak represents multiple transitions of specific peptide as labeled.
Figure 11:
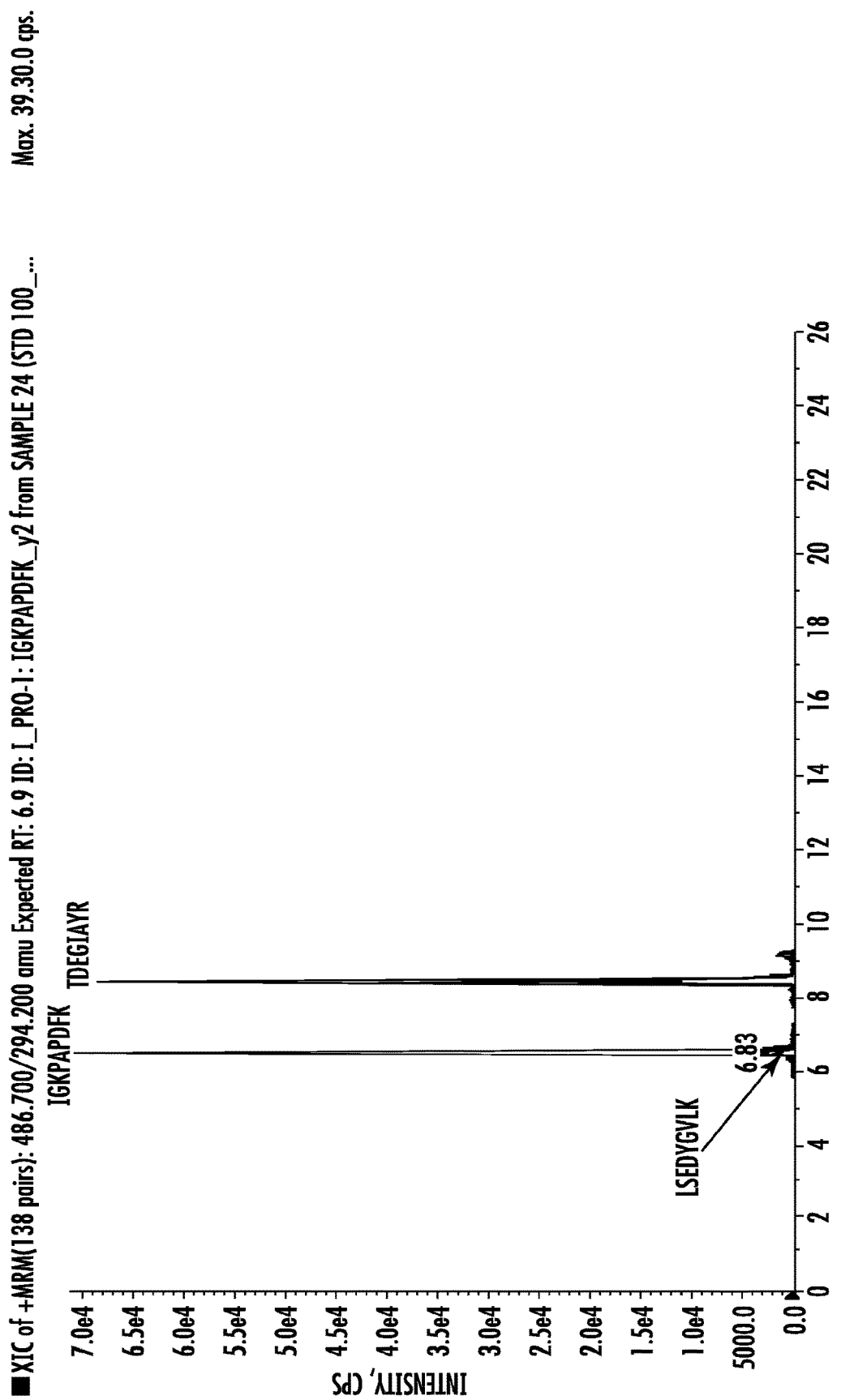
FIG. 11. Extracted ion chromatogram of 3 peptides for Peroxiredoxin. Each peak represents multiple transitions of specific peptide as labeled.
Figure 12:
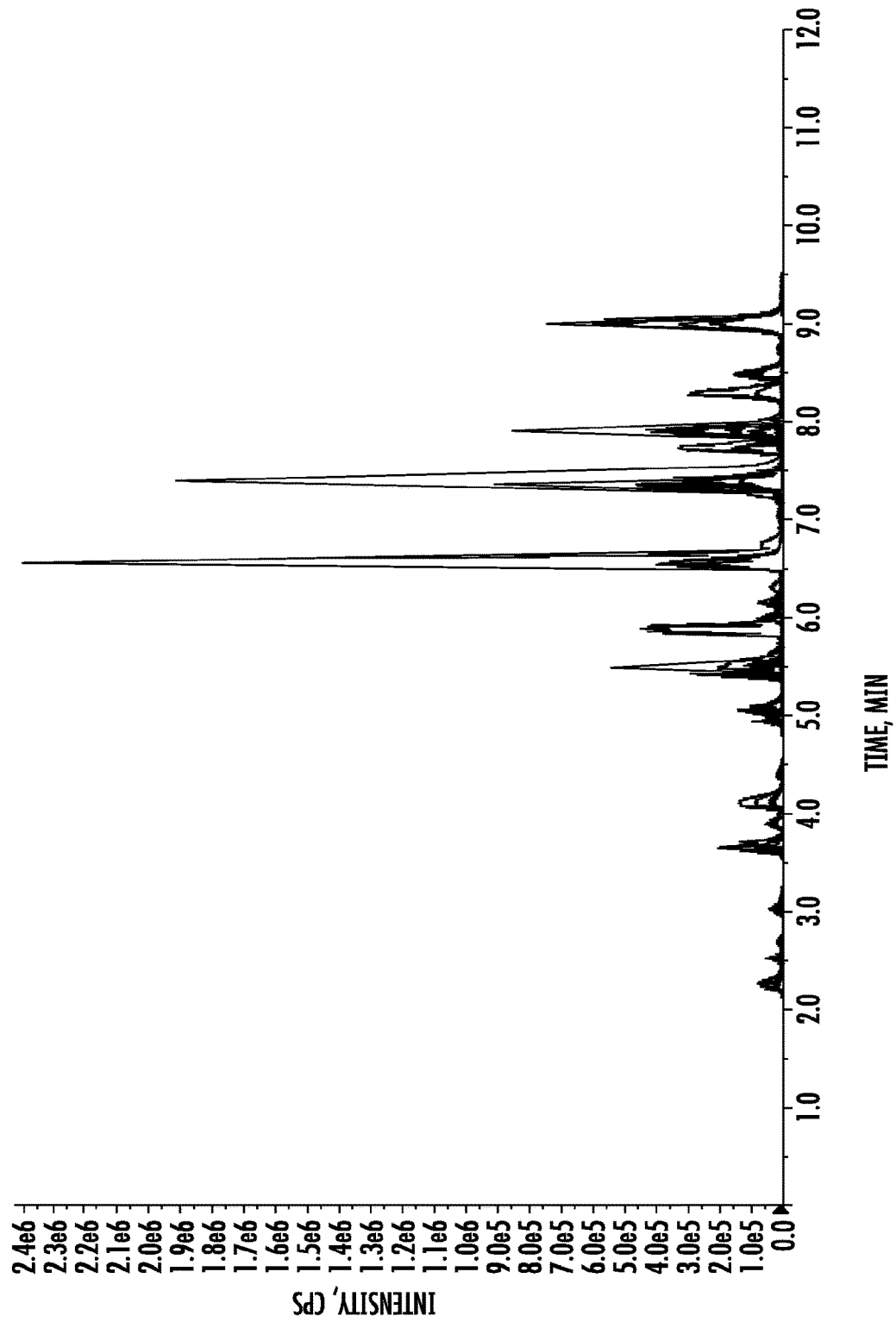
FIG. 12. A representative of MS response, extracted ion chromatograms over time, the overall chromatogram of all specified peptides for each of 8 markers (Apolipoprotein A-II, Carbonic anhydrase 1, CD38 (ADP-ribosyl cyclase/cyclic ADPribose hydrolase, Catalase, Matrix metalloproteinase-9, Isoform 2 of Neutrophil gelatinase associated lipocalin, S100-A7, S100-A8 and with workflow control beta gal) of MRM Example 3.
Figure 13:
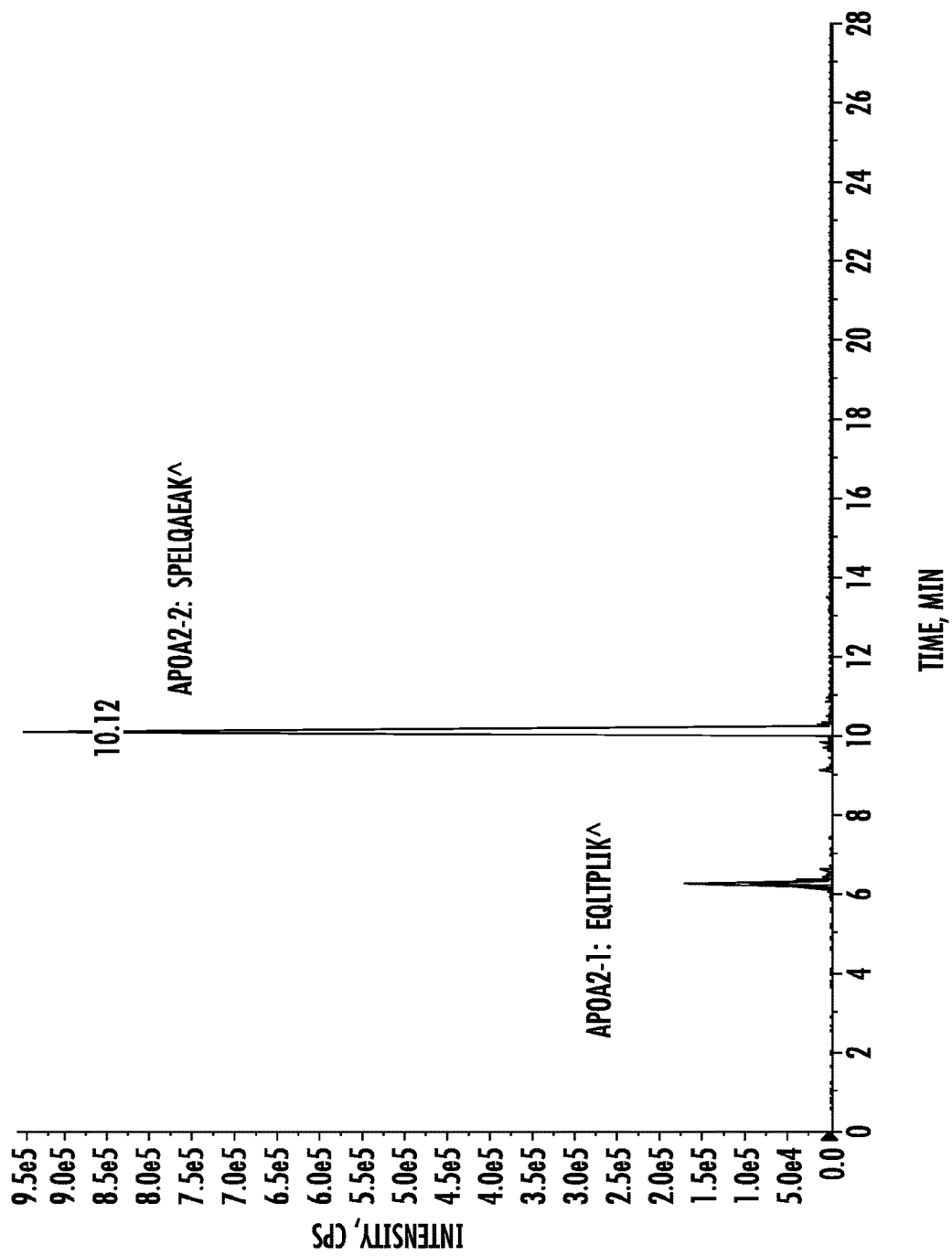
FIG. 13. Extracted ion chromatogram of 2 peptides for Apolipoprotein A-II. Each peak represents multiple transitions of specific peptide as labeled.
Figure 14:
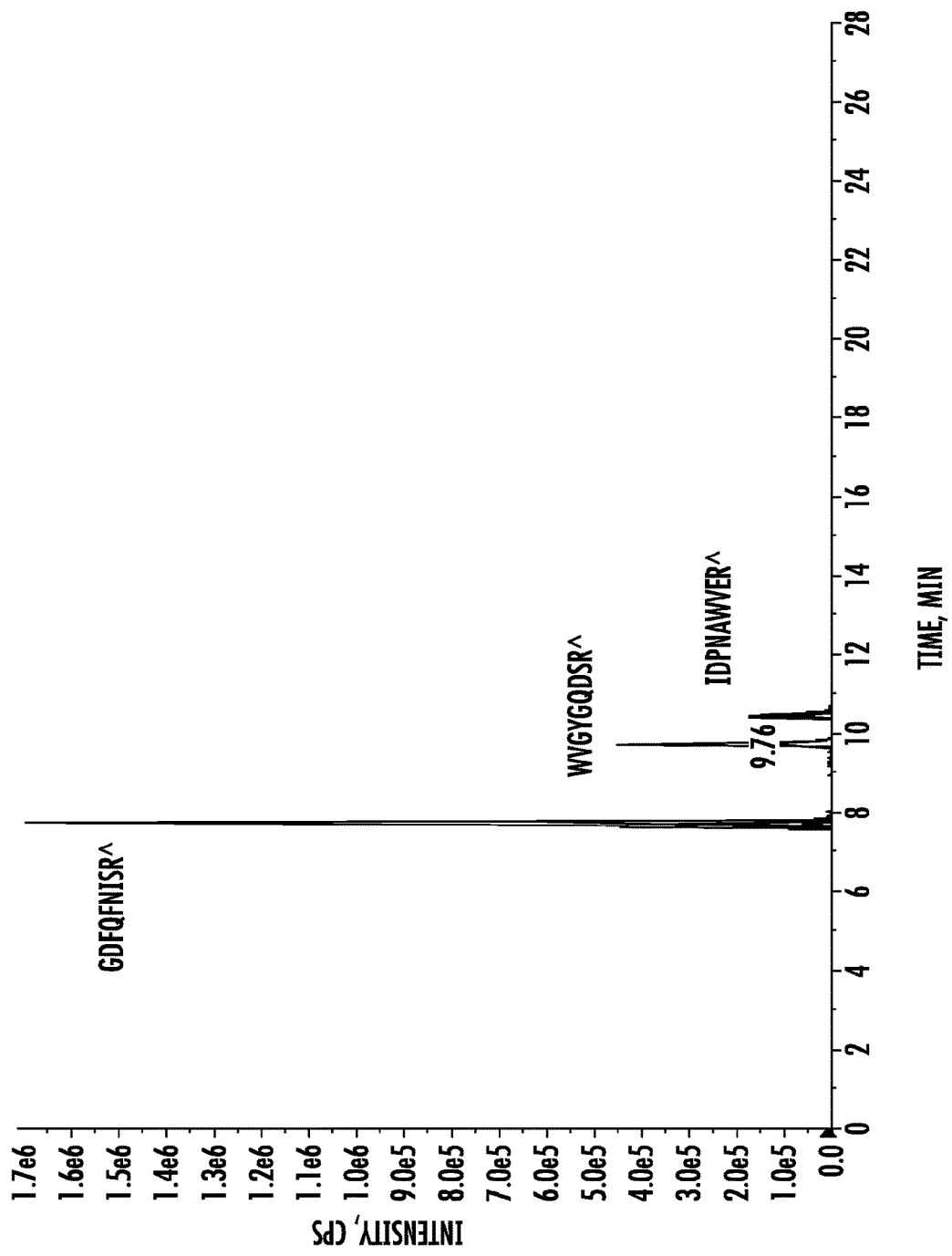
FIG. 14. Extracted ion chromatogram of 3 peptides for Workflow control: Beta-gal-three peptides. Each peak represents multiple transitions of specific peptide as labeled. The same peptides and transitions are also included in the MRM Examples 2 and 4.
Figure 15:
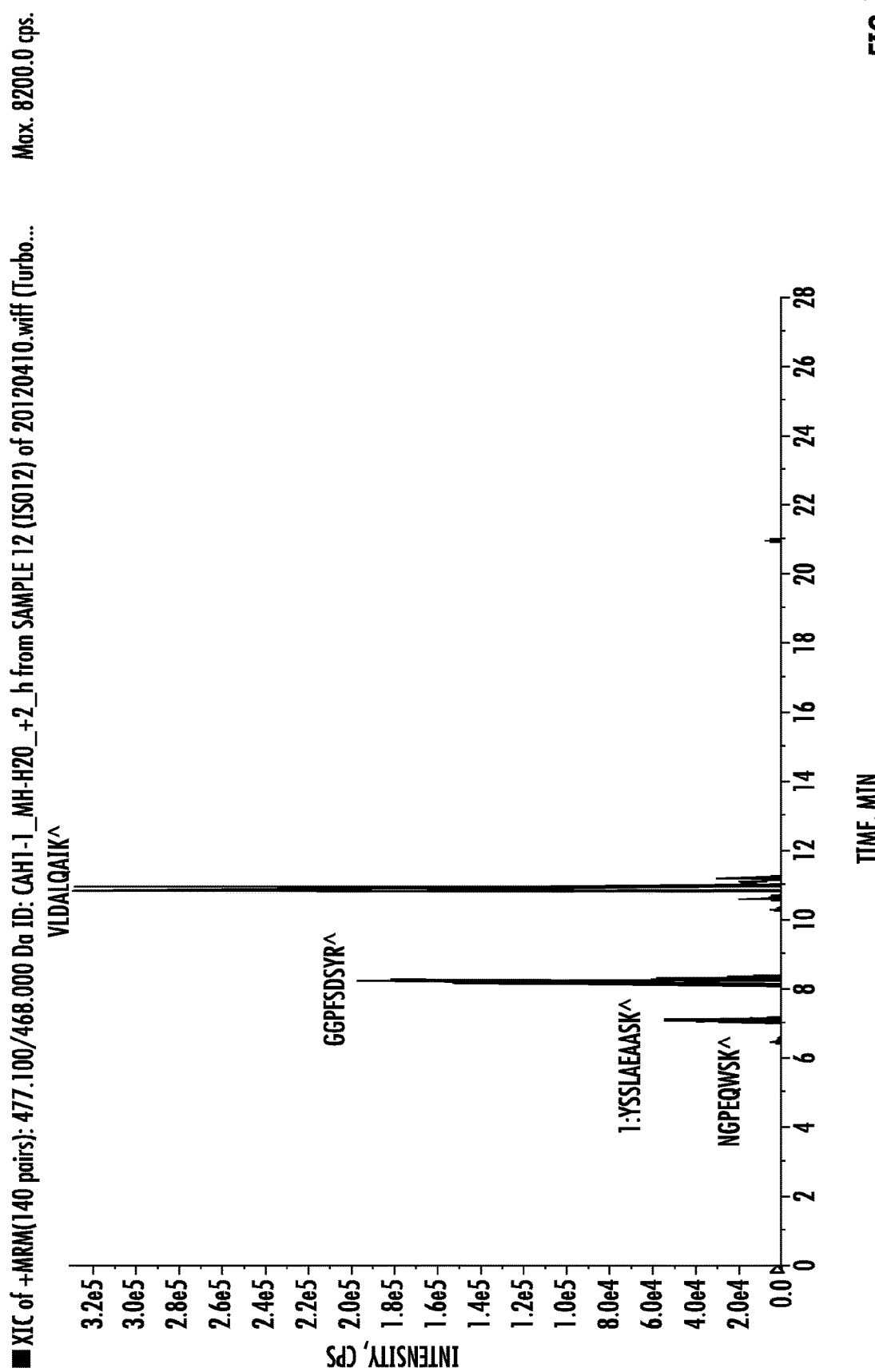
FIG. 15. Extracted ion chromatogram of 4 peptides for Carbonic anhydrase 1. Each peak represents multiple transitions of specific peptide as labeled.
Figure 16:
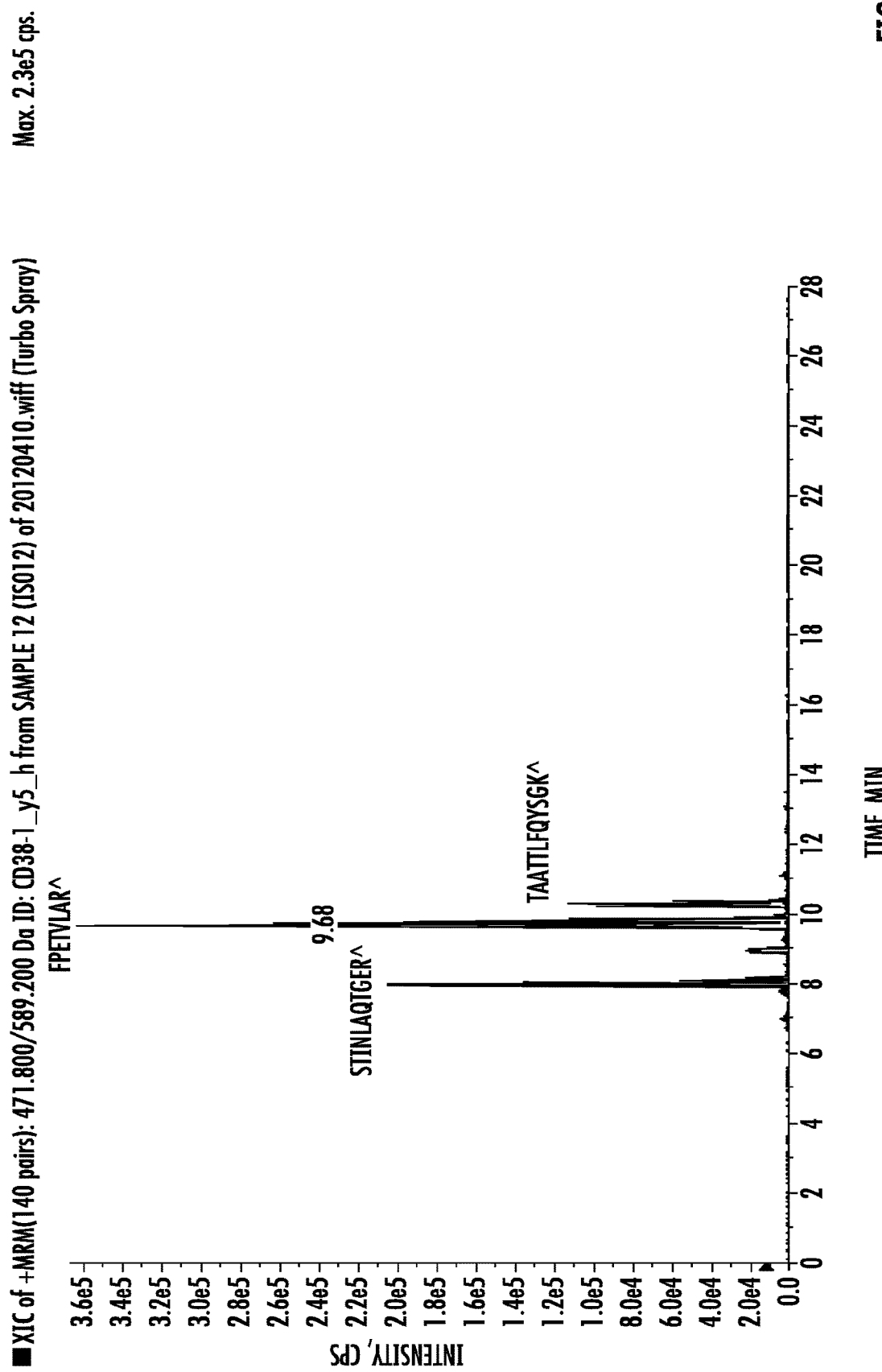
FIG. 16. Extracted ion chromatogram of 3 peptides for CD38 (ADP-ribosyl cyclase/cyclic ADPribose hydrolase). Each peak represents multiple transitions of specific peptide as labeled.
Figure 17:
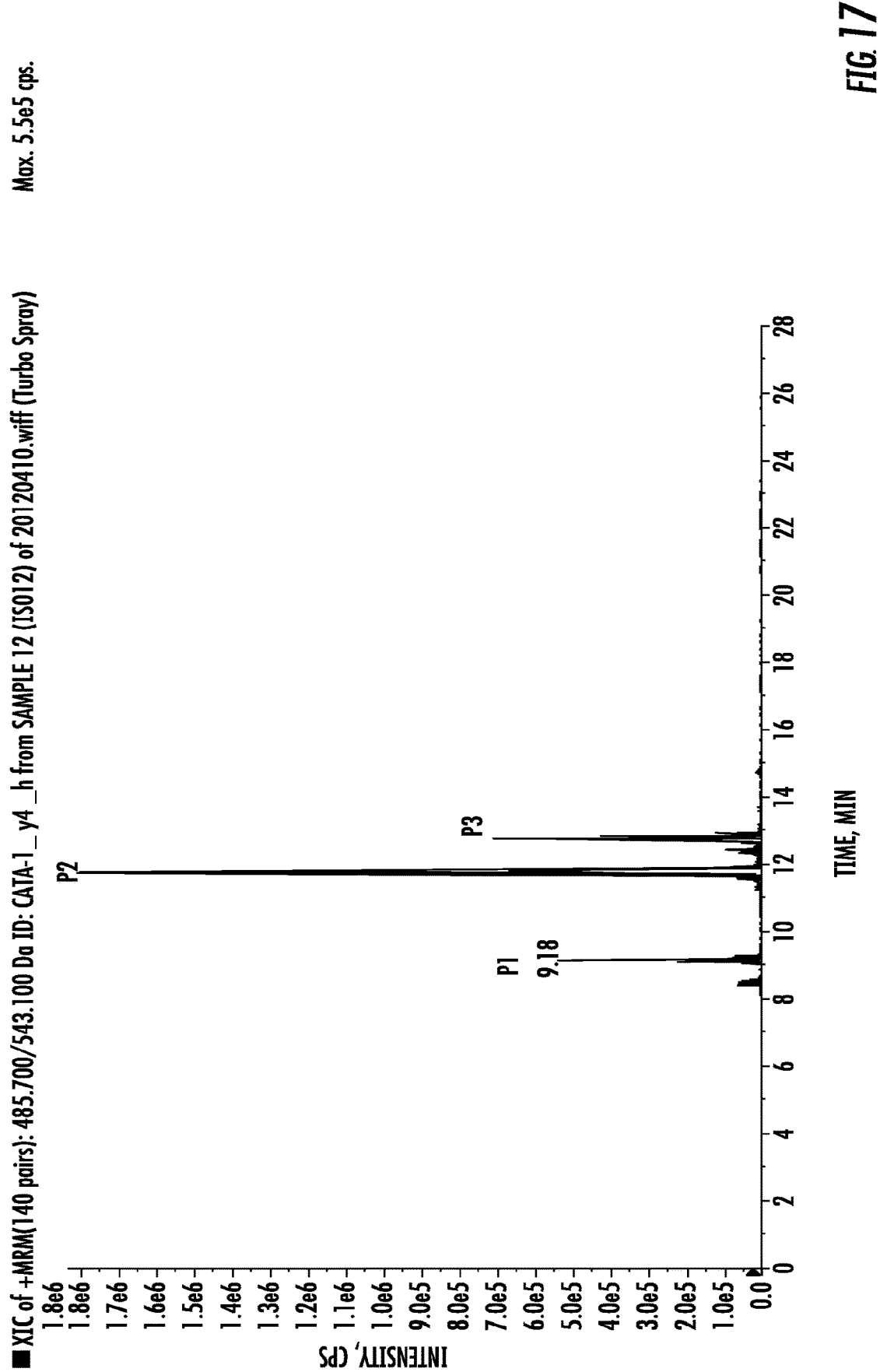
FIG. 17. Extracted ion chromatogram of 3 peptides for Catalase. Each peak represents multiple transitions of specific peptide as labeled.
Figure 18:
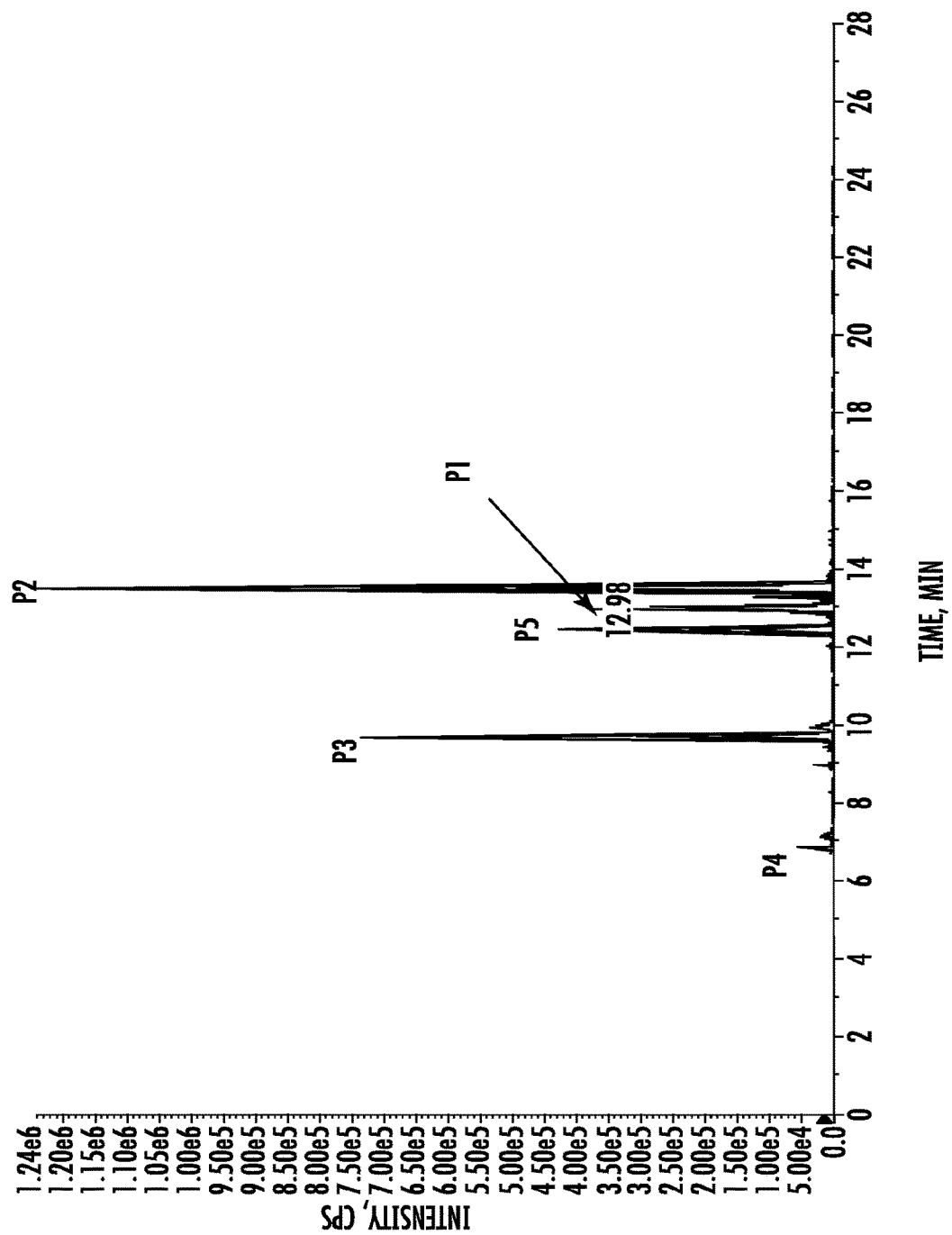
FIG. 18. Extracted ion chromatogram of 5 peptides for Matrix metalloproteinase-9. Each peak represents multiple transitions of specific peptide as labeled.
Figure 19:
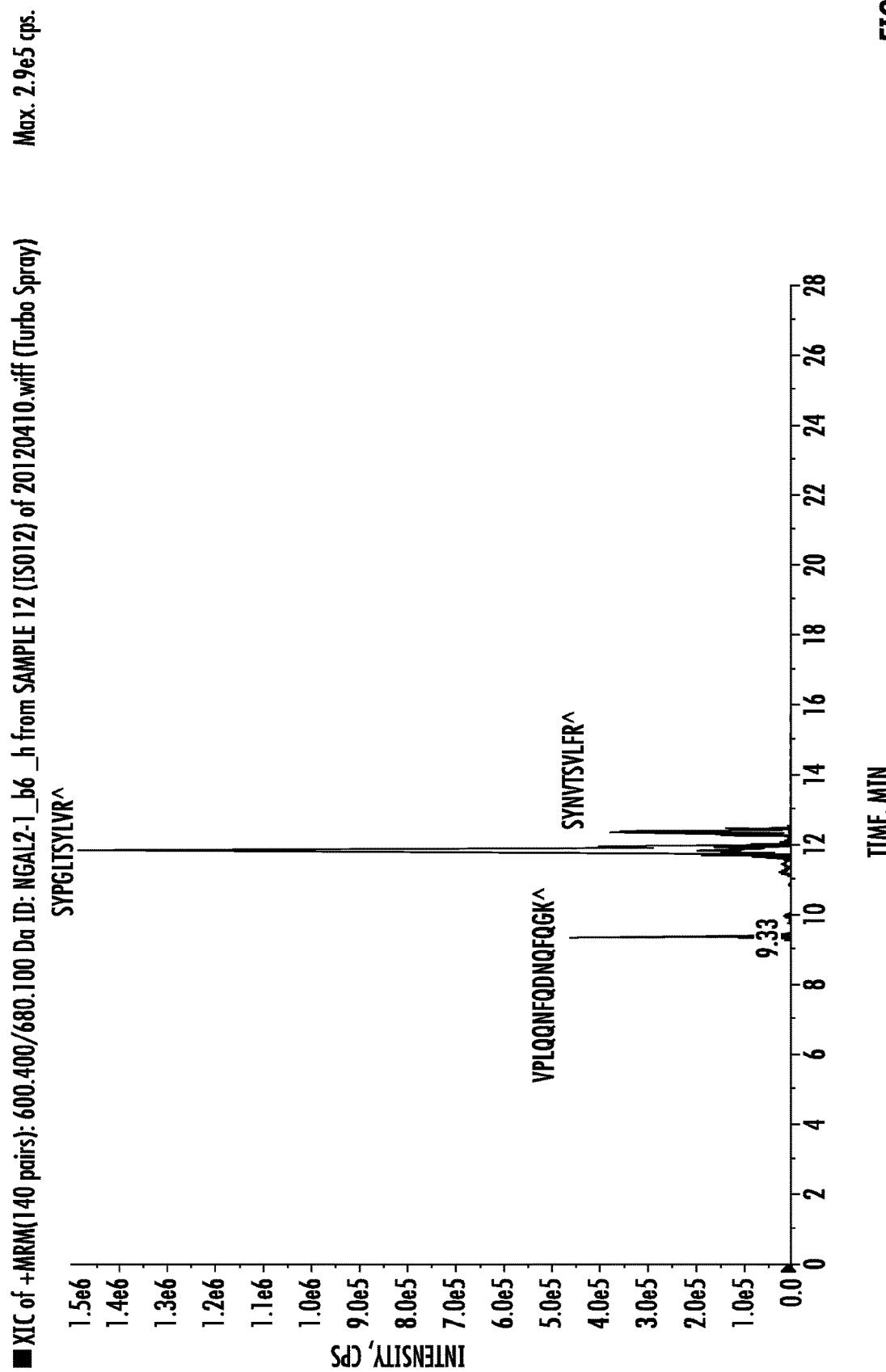
FIG. 19. Extracted ion chromatogram of 3 peptides for Isoform 2 of Neutrophil gelatinase associated lipocalin. Each peak represents multiple transitions of specific peptide as labeled.
Figure 20:
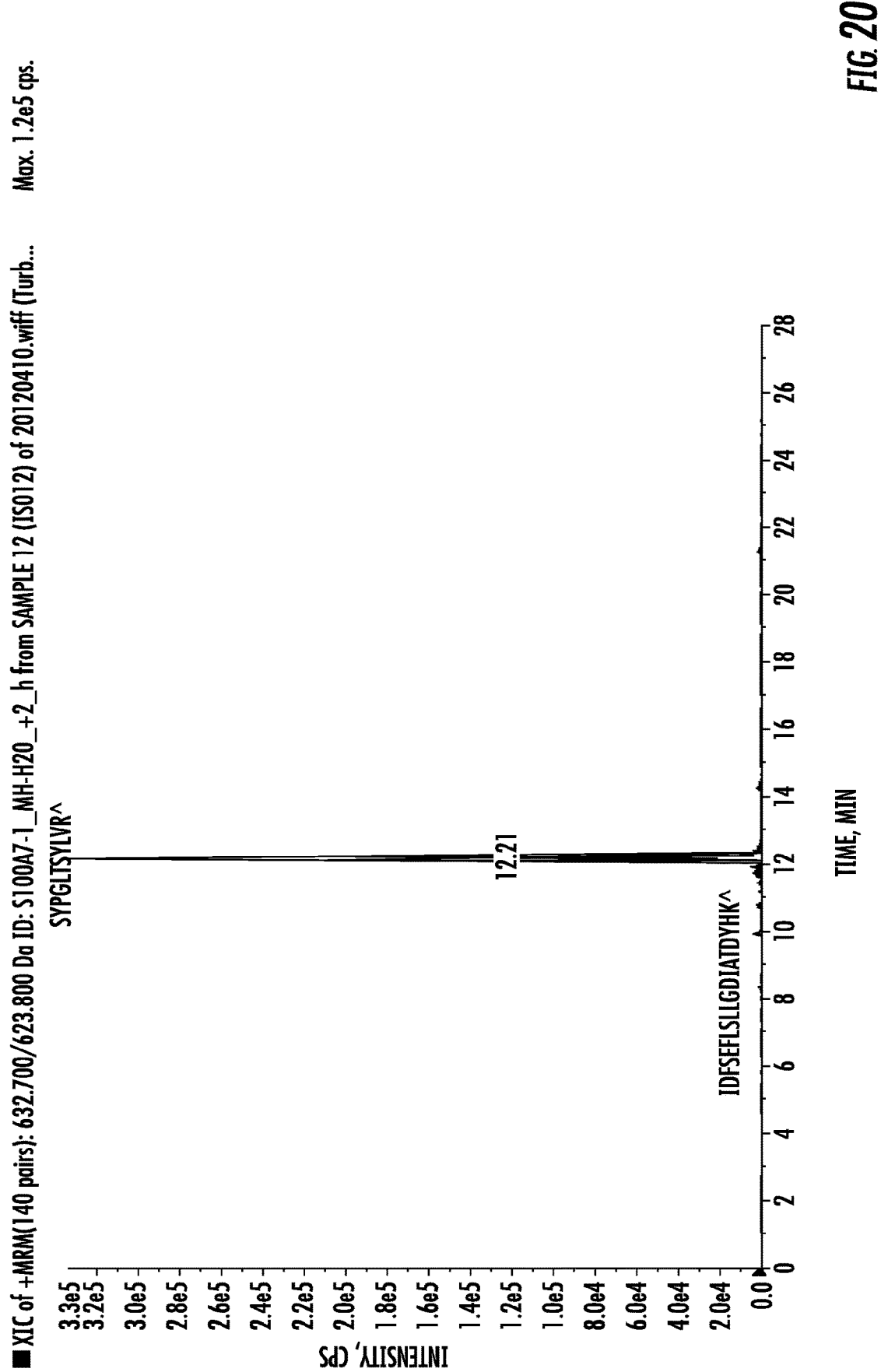
FIG. 20. Extracted ion chromatogram of 2 peptides for S100-A7. Each peak represents multiple transitions of specific peptide as labeled.
Figure 21:
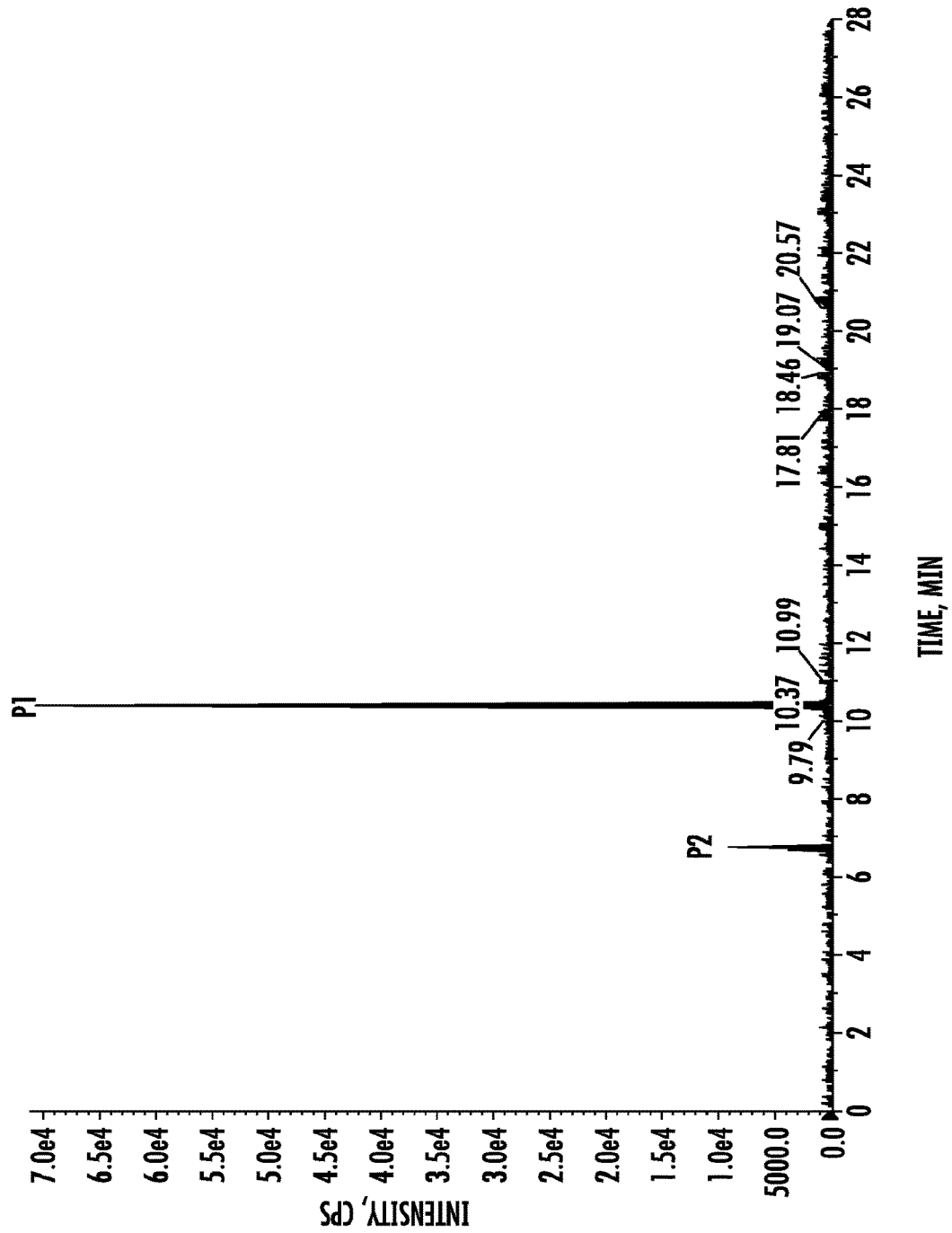
FIG. 21. Extracted ion chromatogram of 2 peptides for S100-A8. Each peak represents multiple transitions of specific peptide as labeled.
Figure 22:
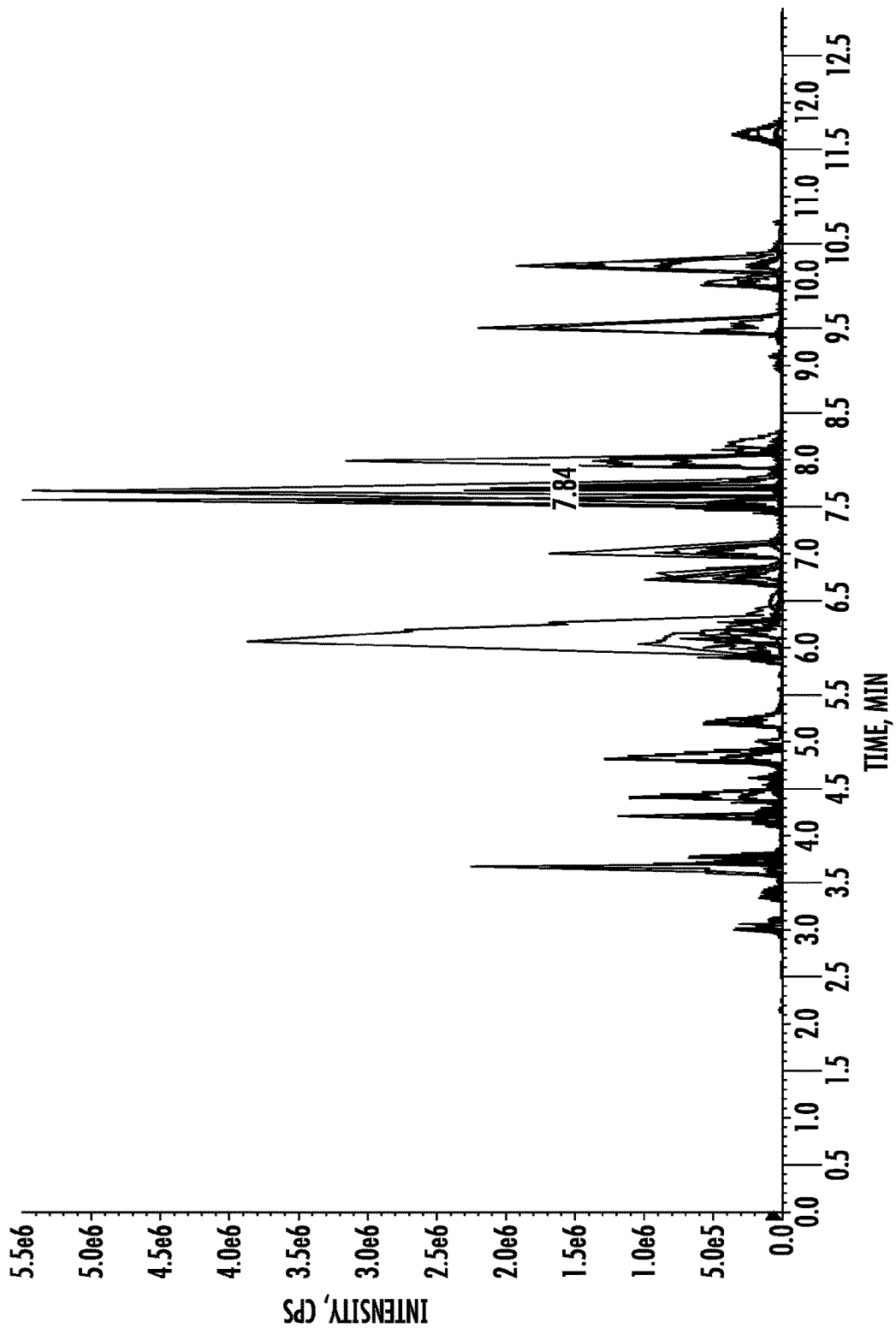
FIG. 22. A representative of MS response, extracted ion chromatograms over time, the overall chromatogram of all specified peptides for each of 10 markers (Beta-Ala-His dipeptidase (CNDP1), Cysteine and glycine-rich protein 1 (CSRP1), Exostosin-like 2, S100A1, S100A12 S100A4, S100A6, for SH3 domain-binding glutamic acid rich-like protein, Thioredoxin, Isoform 2 of Transmembrane protease serine 4 and with workflow control beta gal of MRM Example 4.
Figure 23:
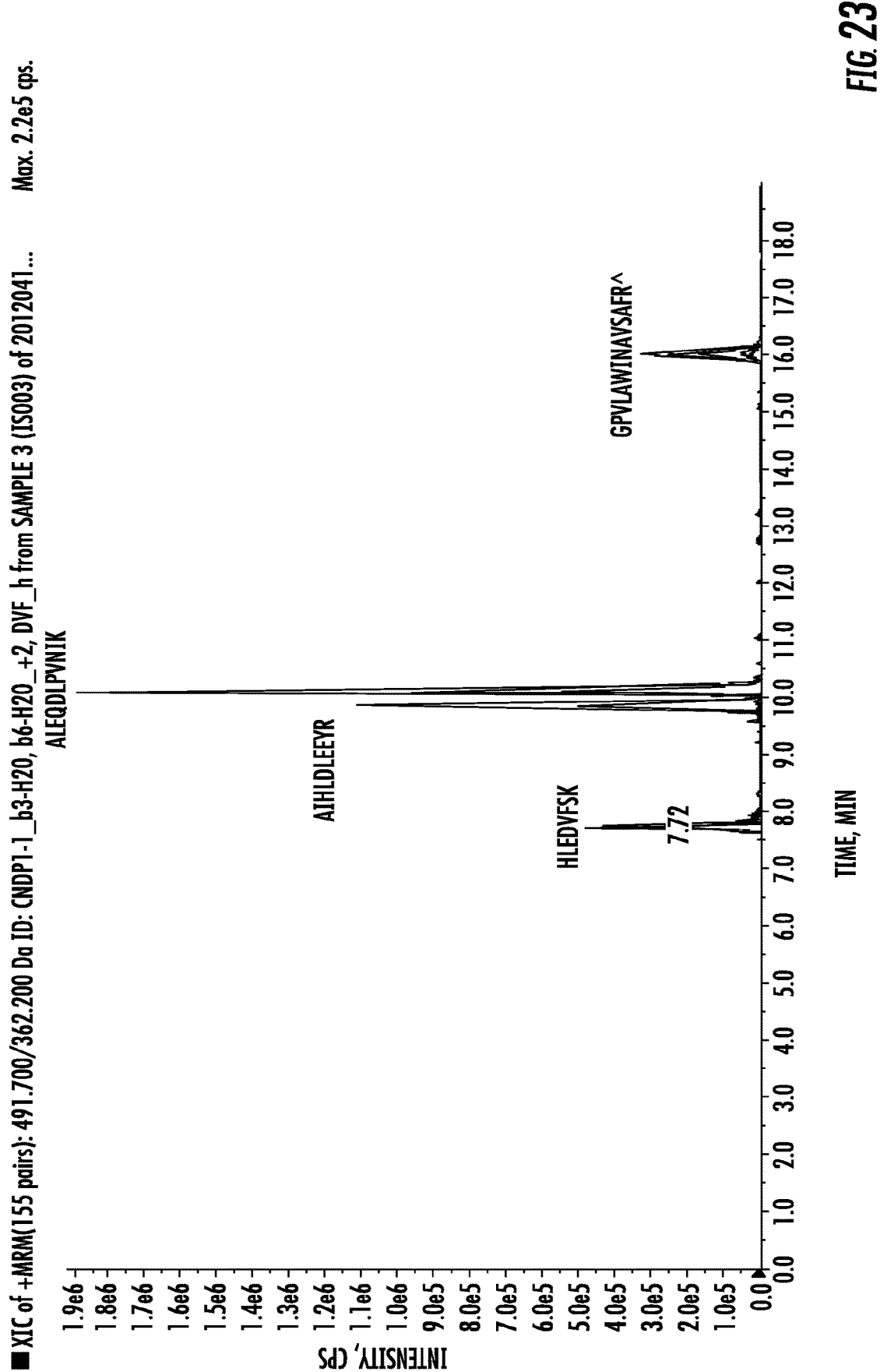
FIG. 23. Extracted ion chromatogram of 4 peptides for Beta-Ala-His dipeptidase (CNDP1). Each peak represents multiple transitions of specific peptide as labeled.
Figure 24:
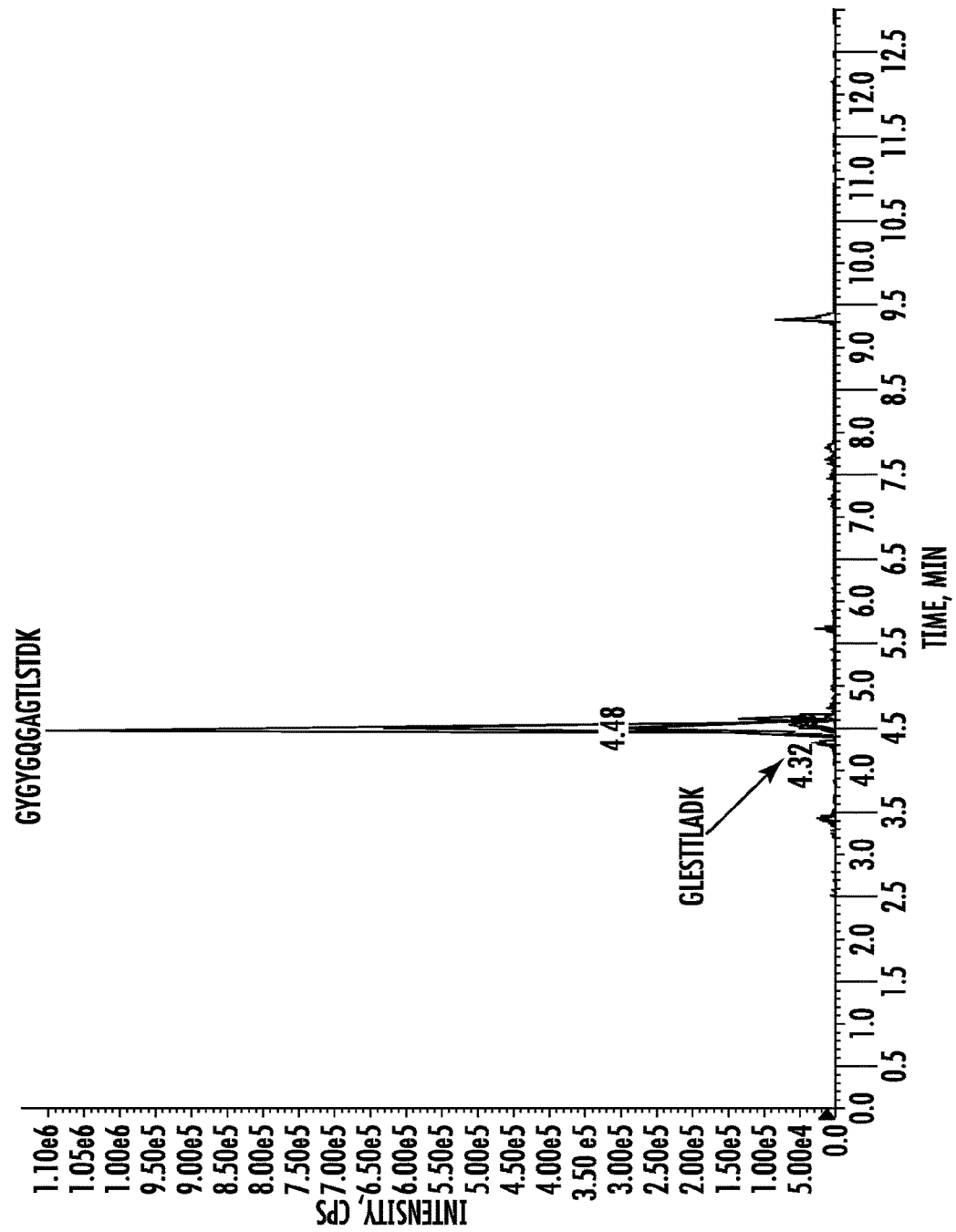
FIG. 24. Extracted ion chromatogram of 2 peptides for Cysteine and glycine-rich protein 1 (CSRP1). Each peak represents multiple transitions of specific peptide as labeled.
Figure 25:
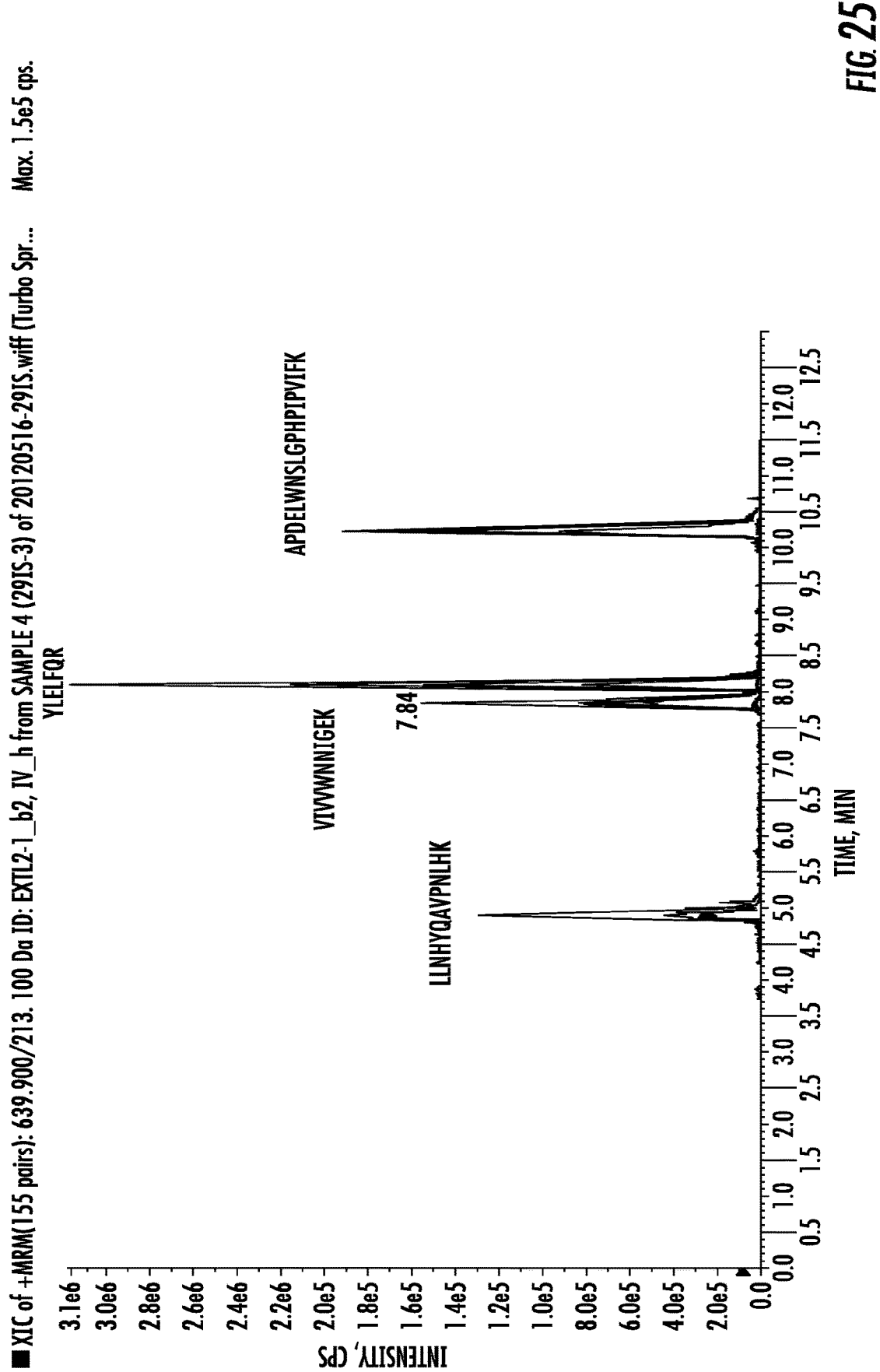
FIG. 25. Extracted ion chromatogram of 4 peptides for Exostosin-like 2. Each peak represents multiple transitions of specific peptide as labeled.
Figure 26:
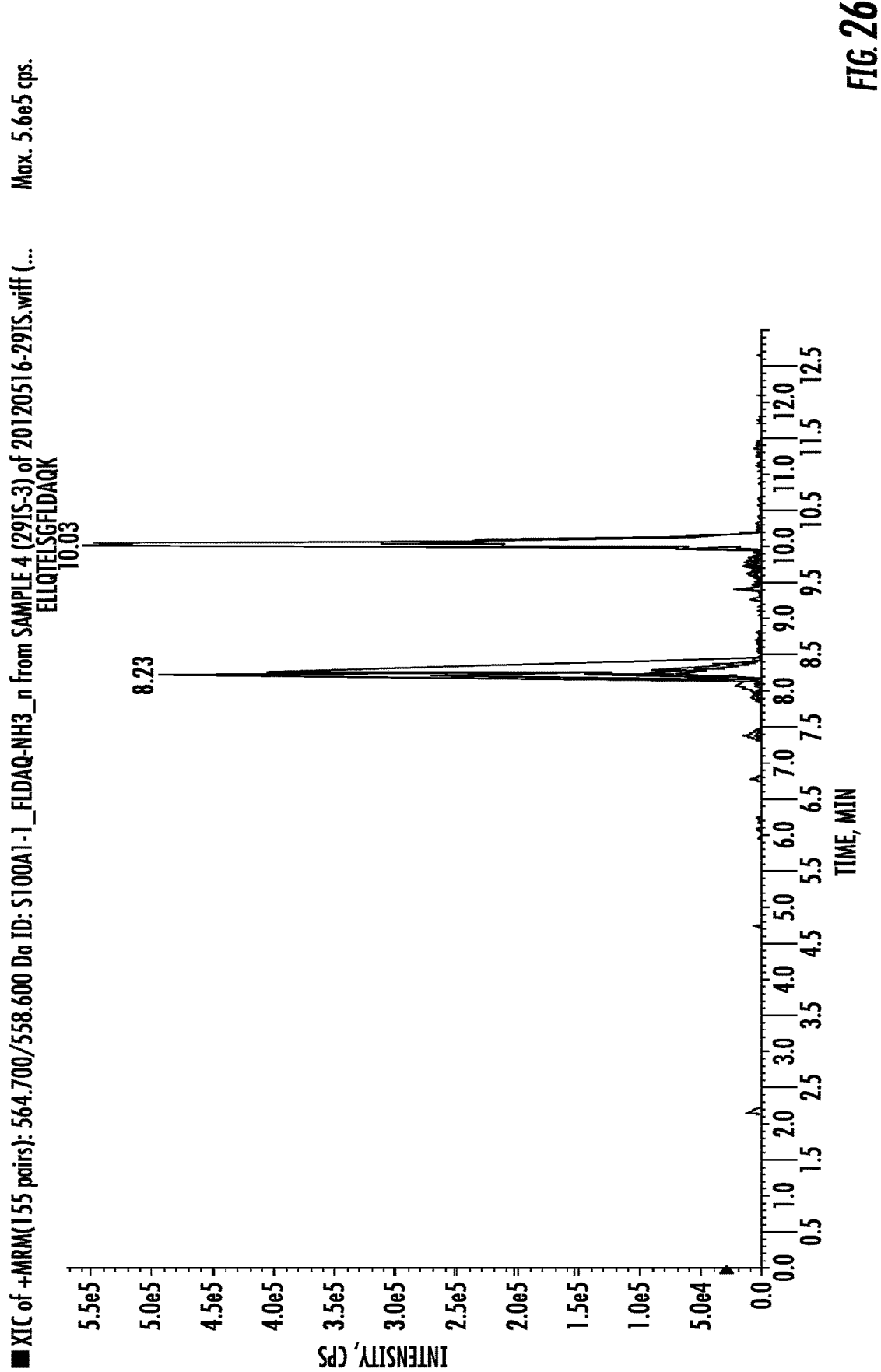
FIG. 26. Extracted ion chromatogram of 1 peptides for S100A1. Each peak represents multiple transitions of specific peptide as labeled.
Figure 27:
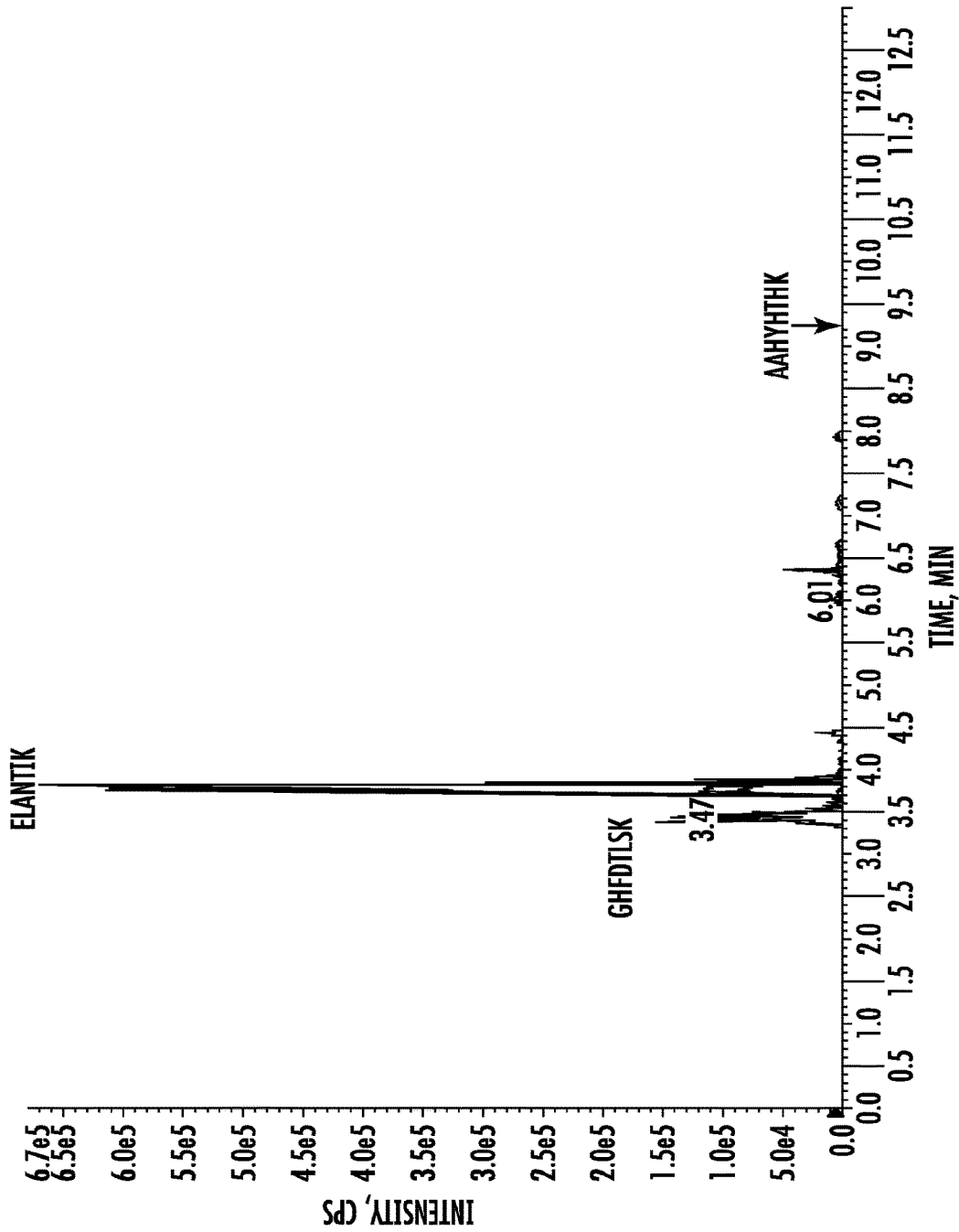
FIG. 27. Extracted ion chromatogram of 3 peptides for S100A12. Each peak represents multiple transitions of specific peptide as labeled.
Figure 28:
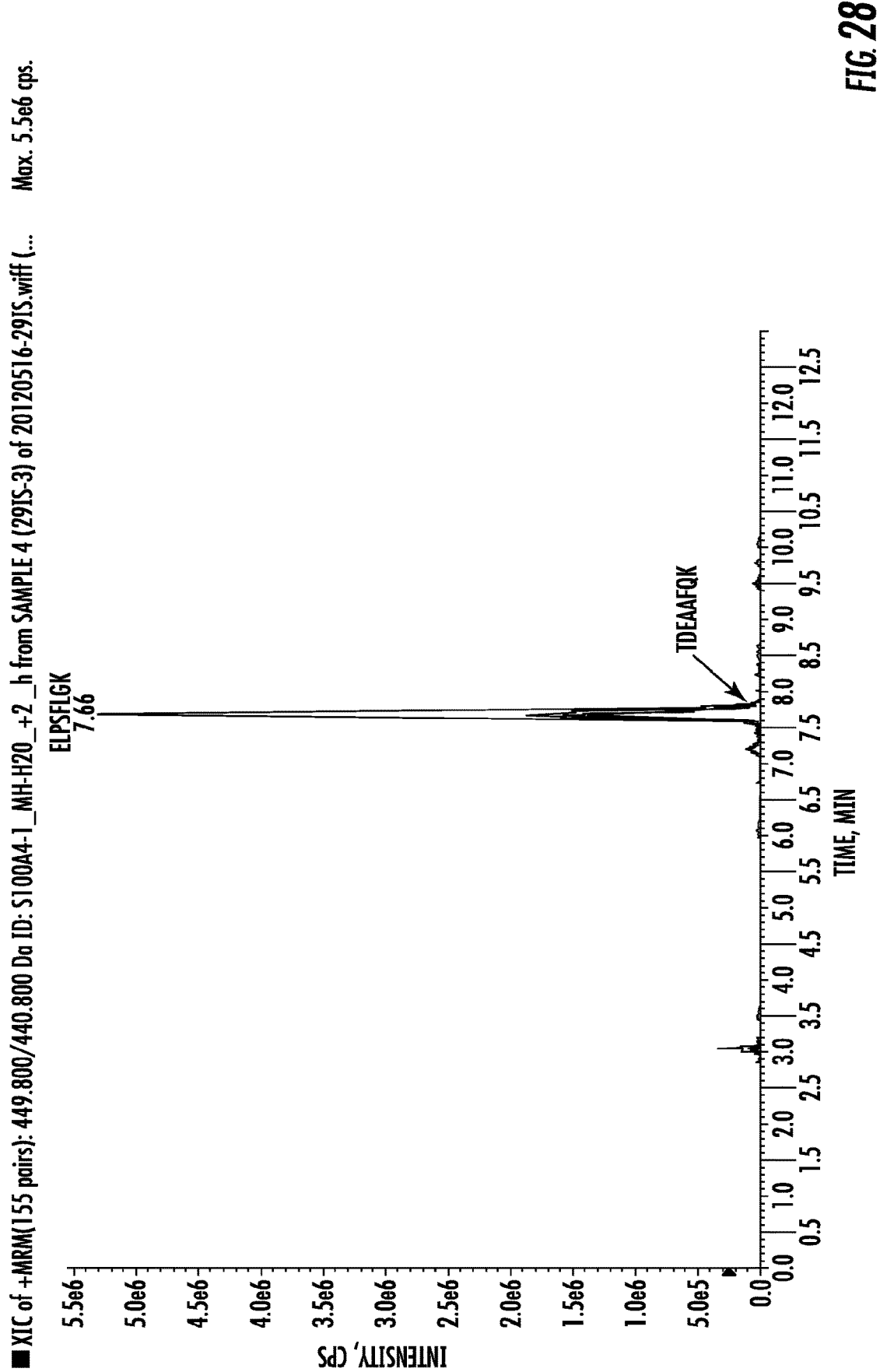
FIG. 28. Extracted ion chromatogram of 2 peptides for S100A4. Each peak represents multiple transitions of specific peptide as labeled.
Figure 29:
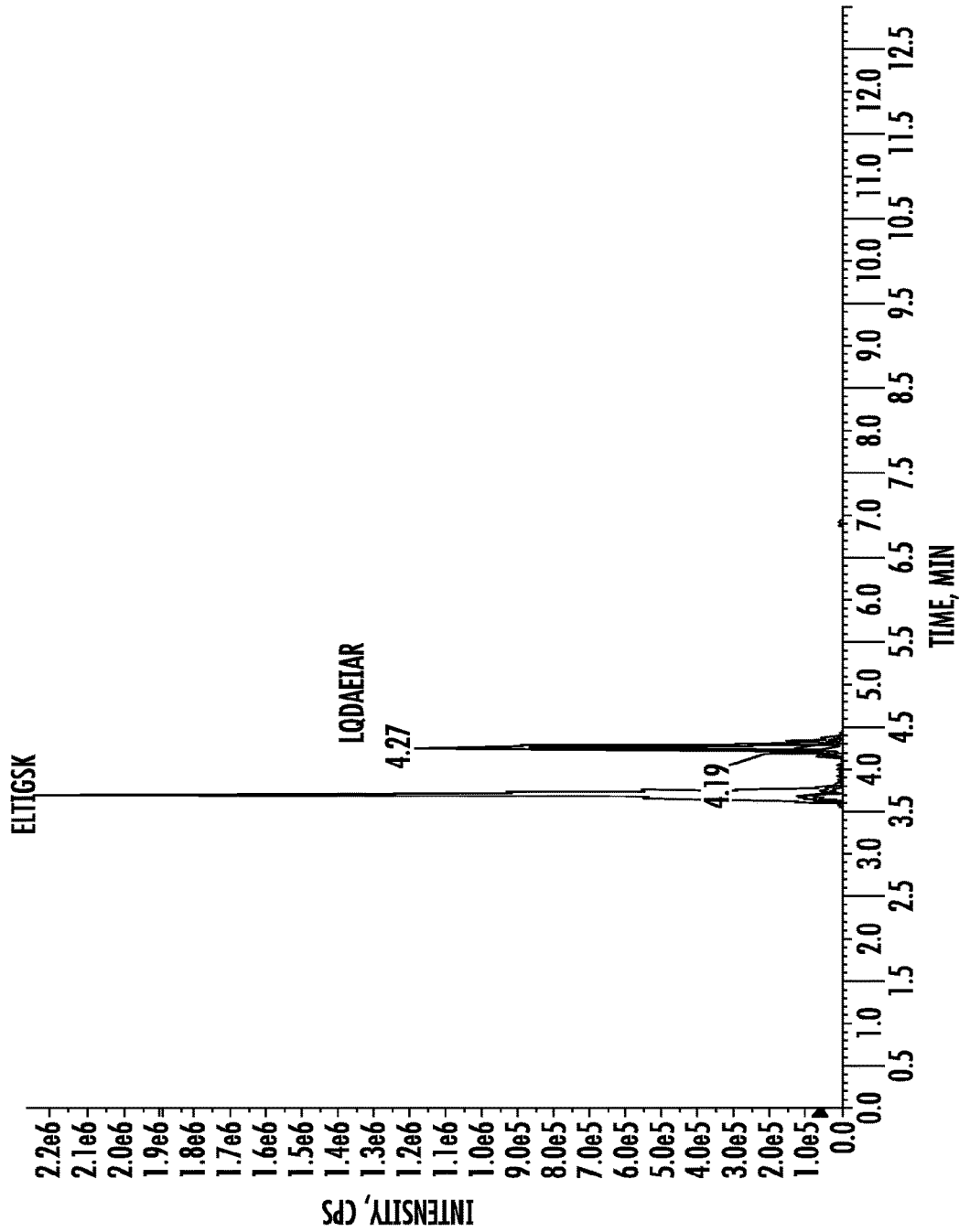
FIG. 29. Extracted ion chromatogram of 2 peptides for S100A6. Each peak represents multiple transitions of specific peptide as labeled.
Figure 30:
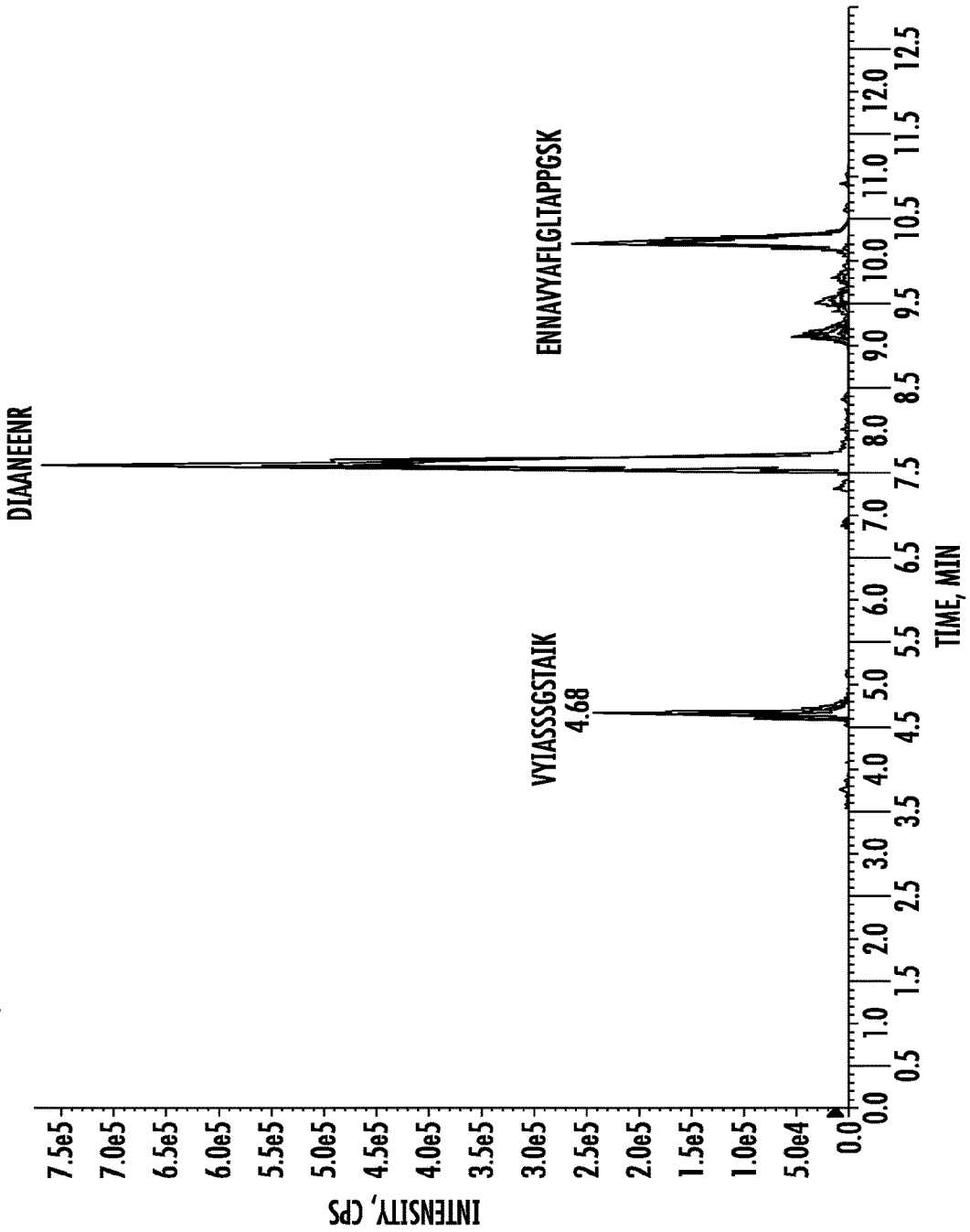
FIG. 30. Extracted ion chromatogram of 3 peptides for SH3 domain-binding glutamic acid rich-like protein. Each peak represents multiple transitions of specific peptide as labeled.
Figure 31:
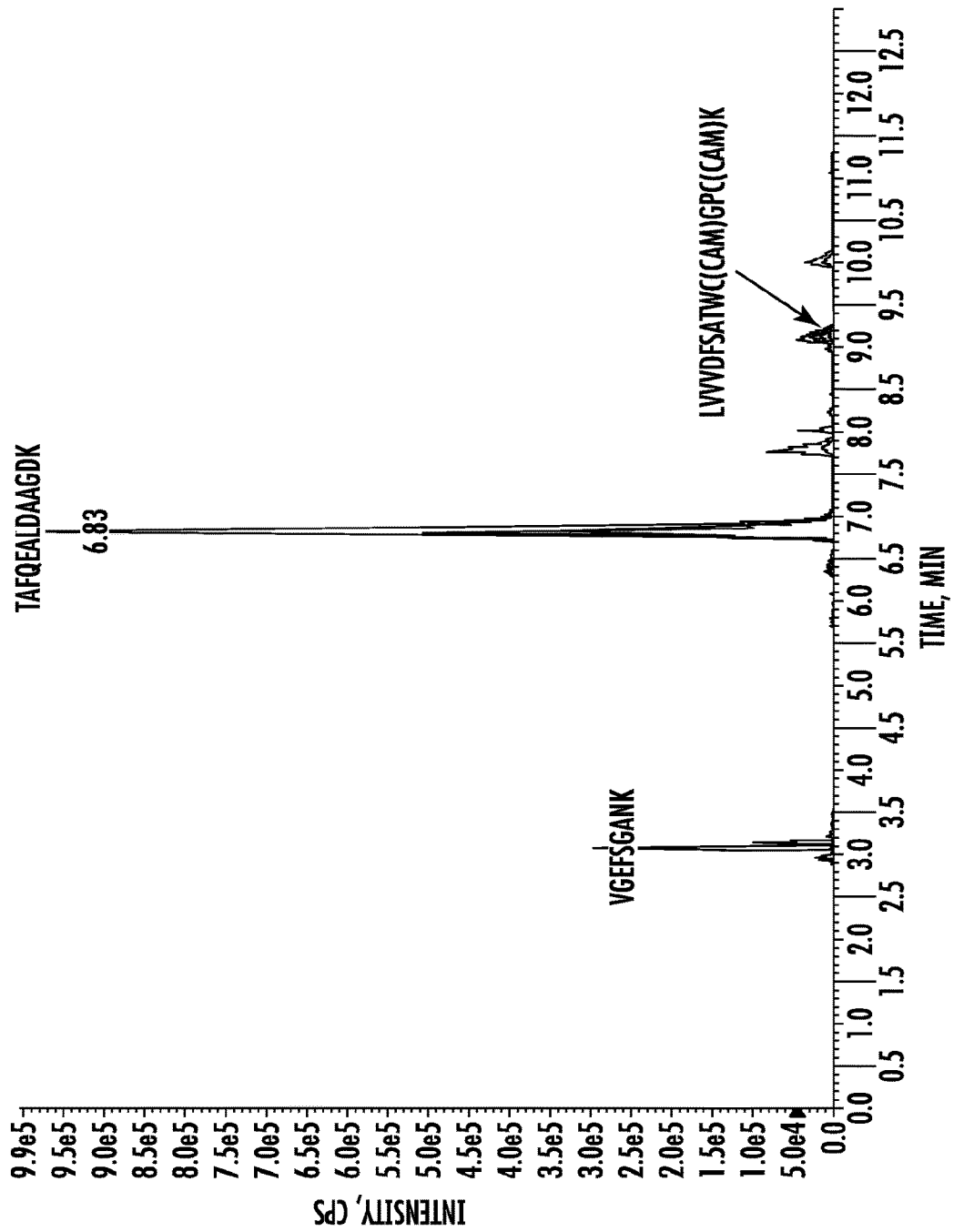
FIG. 31. Extracted ion chromatogram of 3 peptides for Thioredoxin. Each peak represents multiple transitions of specific peptide as labeled.
Figure 32:
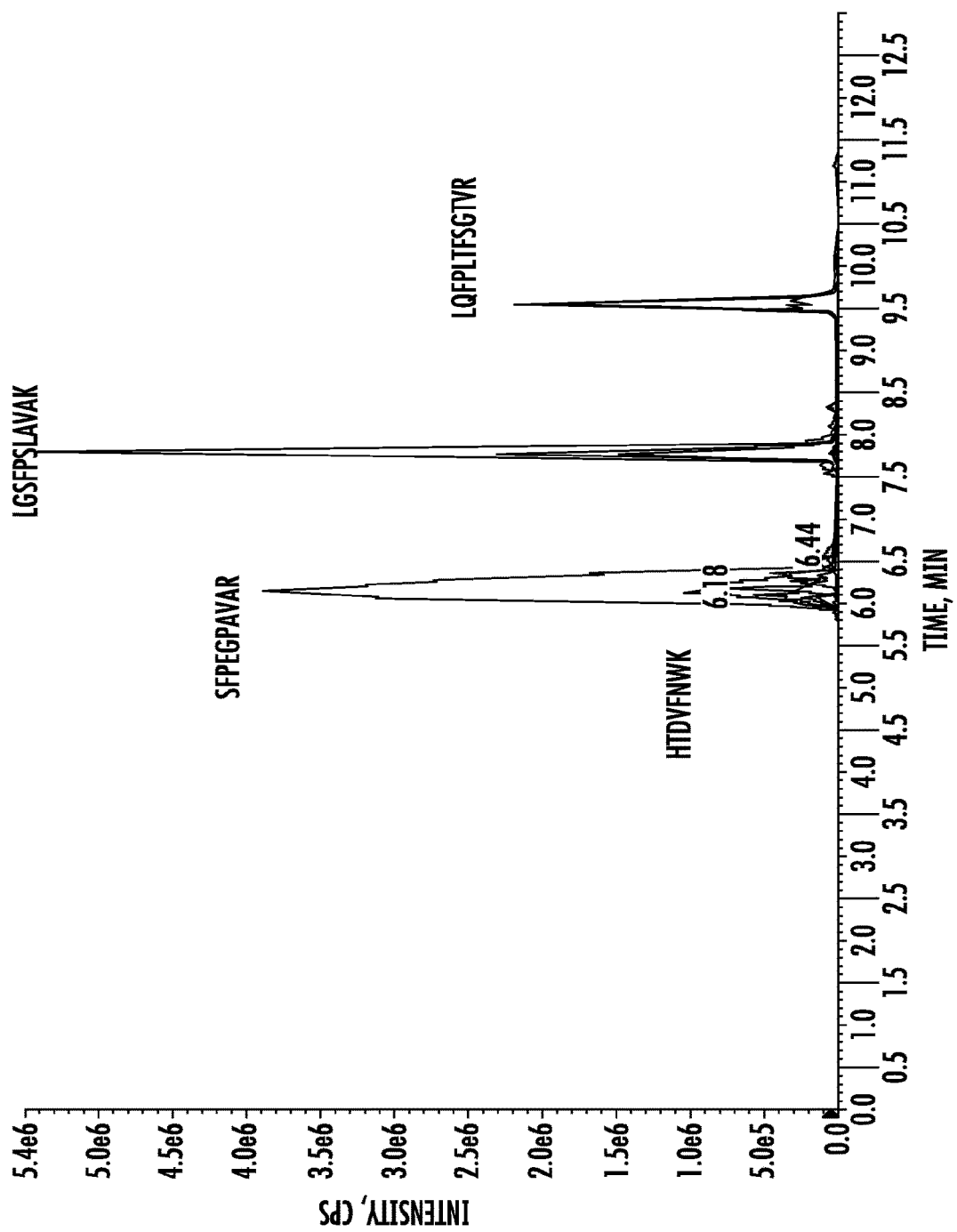
FIG. 32. Extracted ion chromatogram of 4 peptides for Isoform 2 of Transmembrane protease serine 4. Each peak represents multiple transitions of specific peptide as labeled.

Additional markers GM-CSF, IL-10, IL-2, IL-6, IL-8, TNFa, TnI, sICAM, sVCAM, CRP, NTproBNP, IFNg, IL-12 p70, IL-1b, SAA also measured with antibody based simplex or multiplexed analysis. See FIG. 3A-3L.

Emergency Department (ED) cohort. Patients were admitted to the emergency room complaining of chest pain. Blood samples were collected at T0-at admission, T1-one hour after admission, T2-2 hours after admission, T4-4 hours after admission and T8-8 hours after admission. The time points are tracking biomarker rise and sall. Tabls 11 and 12 show results from MRM mass spectrometry based and antibody based analysis of fold of change in MI (myocardial infarction), UA (unstable angina, TnI positive and TnI negative) and NCCP (non-cardiac chest pain). The classification and MI diagnosis were carried by cardiologists.

TABLE 10

ED cohort with MI and UA (Tn+) groups

| | | HR after | fold of change ( normalized to T0 and total protein) | | | | | | | | | | |
|---|---|---|---|---|---|---|---|---|---|---|---|---|---|
| Analyte | Time point | emergency room admission | MI 55T1 | MI 86T1 | MI 87T1 | MI 105T1 | MI 121T1 | MI 125T1 | UA (TnI+) 31T1 | UA (TnI+) 41T1 | UA (TnI+) 56T1 | UA (TnI+) 110T1 | UA (TnI+) 171T1 |
| LTF-MRM | 0 | 0 HR | 1.0 | 1.0 | 1.0 | 1.0 | 1.0 | 1.0 | 1.0 | 1.0 | 1.0 | 1.0 | 1.0 |
| LTF-MRM | 1 | 1 HR | 0.6 | 1.4 | 1.1 | 1.4 | 1.3 | 2.4 | 0.7 | 0.7 | 0.9 | 0.5 | 0.8 |
| LTF-MRM | 4 | 2 HR | 1.3 | 1.4 | 1.2 | 2.3 | 1.5 | | 0.5 | 0.8 | 1.4 | 0.8 | 1.1 |
| LTF-MRM | 8 | 8 HR | 1.2 | 0.9 | 1.1 | 1.6 | 1.5 | 2.7 | 0.5 | 0.5 | 1.5 | 1.4 | 0.7 |
| S100A9-MRM | 0 | 0 HR | 1.0 | 1.0 | 1.0 | 1.0 | 1.0 | 1.0 | 1.0 | 1.0 | 1.0 | 1.0 | 1.0 |
| S100A9-MRM | 1 | 1 HR | 0.6 | 1.8 | 0.9 | 1.0 | 2.3 | 3.2 | 0.6 | 0.5 | 0.8 | 0.3 | 0.7 |
| S100A9-MRM | 4 | 2 HR | 2.1 | 2.2 | 1.8 | 2.8 | 2.8 | 0.0 | 0.6 | 1.0 | 2.6 | 0.5 | 0.8 |
| S100A9-MRM | 8 | 8 HR | 1.3 | 1.0 | 2.2 | 4.7 | 2.3 | 4.6 | 0.5 | 0.5 | 2.4 | 0.8 | 0.4 |
| PRD-MRM | 0 | 0 HR | 1.0 | 1.0 | 1.0 | 1.0 | 1.0 | 1.0 | 1.0 | 1.0 | 1.0 | 1.0 | 1.0 |
| PRD-MRM | 1 | 1 HR | 2.6 | 8.6 | 1.6 | 0.8 | 1.5 | 1.8 | 1.4 | 0.9 | 0.2 | 3.8 | 0.9 |
| PRD-MRM | 2 | 2 HR | 7.1 | 5.8 | 2.3 | 0.7 | 1.7 | | 1.4 | 6.0 | 0.5 | 1.2 | 5.0 |
| PRD-MRM | 8 | 8 HR | 1.0 | 1.6 | 1.2 | 2.9 | 2.7 | 1.6 | 2.8 | 2.0 | 0.4 | 0.7 | 1.5 |
| S100A9/A8-ELISA | 0 | 0 HR | 1.0 | 1.0 | 1.0 | 1.0 | 1.0 | 1.0 | 1.0 | 1.0 | 1.0 | 1.0 | 1.0 |
| S100A9/A8-ELISA | 1 | 1 HR | 1.1 | 1.1 | 1.1 | 1.1 | 1.9 | 1.8 | 0.6 | 0.5 | 1.5 | 0.7 | 0.7 |
| S100A9/A8-ELISA | 2 | 2 HR | 2.3 | 1.2 | 1.9 | 2.0 | 2.1 | | 0.6 | 0.8 | 2.0 | 0.8 | 0.8 |
| S100A9/A8-ELISA | 8 | 8 HR | 2.0 | 0.8 | 2.0 | 2.6 | 2.1 | 2.6 | 0.5 | 0.6 | 2.1 | 1.0 | 0.6 |
| | | | 1.6 | 1.0 | 1.5 | 1.7 | 1.8 | 1.8 | 0.7 | 0.7 | 1.7 | 0.9 | 0.8 |
| Lactoferrin-ELISA | 0 | 0 HR | 1.0 | 1.0 | 1.0 | 1.0 | 1.0 | #VALUE! | 1.0 | 1.0 | 1.0 | 1.0 | 1.0 |
| Lactoferrin-ELISA | 1 | 1 HR | 0.4 | 0.9 | 1.8 | 1.1 | 1.5 | #VALUE! | 0.6 | 0.4 | 1.1 | 0.3 | 0.6 |
| Lactoferrin-ELISA | 2 | 2 HR | 0.9 | 1.1 | 1.0 | 2.2 | 3.4 | | 0.5 | 0.6 | 1.7 | 0.6 | 0.7 |
| Lactoferrin-ELISA | 8 | 8 HR | 1.2 | 0.4 | 1.3 | 1.7 | 1.6 | #VALUE! | 0.5 | 0.7 | 1.9 | 1.1 | 0.5 |

TABLE 11

ED cohort with UA (Tn1) and NCCP groups

| | | HR after | fold of change ( normalized to T0 and total protein) | | | | | |
|---|---|---|---|---|---|---|---|---|
| Analyte | Time point | emergency room admission | UA (TnI−) 50T1 | UA (TnI−) 102T1 | UA (TnI−) 127T1 | UA (TnI−) 131T1 | UA (TnI−) 164T1 | NCCP 24T1 |
| LTF-MRM | 0 | 0 HR | 1.0 | 1.0 | 1.0 | 1.0 | 1.0 | 1.0 |
| LTF-MRM | 1 | 1 HR | 0.6 | 0.9 | 0.6 | 1.2 | 0.8 | 0.5 |

TABLE 11-continued

ED cohort with UA (Tn1) and NCCP groups

| | | | | | | | | |
|---|---|---|---|---|---|---|---|---|
| LTF-MRM | 4 | 2 HR | 0.5 | 0.5 | 0.8 | 1.4 | 0.8 | 0.9 |
| LTF-MRM | 8 | 8 HR | 0.4 | 0.6 | 0.4 | 1.9 | 1.0 | 0.7 |
| S100A9-MRM | 0 | 0 HR | 1.0 | 1.0 | 1.0 | 1.0 | 1.0 | 1.0 |
| S100A9-MRM | 1 | 1 HR | 0.8 | 0.7 | 0.5 | 3.3 | 0.8 | 0.2 |
| S100A9-MRM | 4 | 2 HR | 0.8 | 0.5 | 0.8 | 3.7 | 0.4 | 0.7 |
| S100A9-MRM | 8 | 8 HR | 0.4 | 0.6 | 0.4 | 4.4 | 0.6 | 0.4 |
| PRD-MRM | 0 | 0 HR | 1.0 | 1.0 | 1.0 | 1.0 | 1.0 | 1.0 |
| PRD-MRM | 1 | 1 HR | 1.2 | 1.3 | 1.1 | 1.5 | 1.4 | 0.8 |
| PRD-MRM | 2 | 2 HR | 1.9 | 0.7 | 2.0 | 4.8 | 0.8 | 1.1 |
| PRD-MRM | 8 | 8 HR | 0.8 | 1.4 | 1.2 | 1.5 | 0.8 | 1.2 |
| S100A9/A8-ELISA | 0 | 0 HR | 1.0 | 1.0 | 1.0 | 1.0 | 1.0 | 1.0 |
| S100A9/A8-ELISA | 1 | 1 HR | 0.7 | 1.0 | 1.1 | 1.3 | 1.1 | 0.4 |
| S100A9/A8-ELISA | 2 | 2 HR | 0.7 | 0.9 | 1.0 | 1.1 | 0.7 | 0.8 |
| S100A9/A8-ELISA | 8 | 8 HR | 0.4 | 1.3 | 1.0 | 1.9 | 1.5 | 0.8 |
| | | | 0.7 | 1.1 | 1.0 | 1.3 | 1.1 | 0.7 |
| Lactoferrin-ELISA | 0 | 0 HR | 1.0 | 1.0 | 1.0 | 1.0 | 1.0 | 1.0 |
| Lactoferrin-ELISA | 1 | 1 HR | 0.7 | 0.6 | 0.3 | 0.8 | 0.7 | 0.2 |
| Lactoferrin-ELISA | 2 | 2 HR | 0.4 | 0.4 | 0.6 | 0.6 | 0.3 | 0.7 |
| Lactoferrin-ELISA | 8 | 8 HR | 0.2 | 0.3 | 0.3 | 0.9 | 0.5 | 0.5 | fold of change ( normalized to T0 and total protein)

| Analyte | NCCP 30T1 | NCCP 38T1 | NCCP 42T1 | NCCP 94T1 | NCCP 95T1 | NCCP 123T1 | NCCP 134T1 | NCCP 146T1 | NCCP 147T1 |
|---|---|---|---|---|---|---|---|---|---|
| LTF-MRM | 1.0 | 1.0 | 1.0 | 1.0 | 1.0 | 1.0 | 1.0 | 1.0 | 1.0 |
| LTF-MRM | 0.1 | 1.0 | 0.4 | 1.5 | 0.5 | 0.8 | 0.5 | 1.2 | 1.5 |
| LTF-MRM | 0.1 | 1.1 | 0.9 | 1.6 | 0.9 | 0.8 | 0.6 | 0.9 | 1.6 |
| LTF-MRM | 0.1 | 1.2 | 0.3 | 1.4 | 0.8 | 0.9 | 0.9 | 1.9 | 1.2 |
| S100A9-MRM | 1.0 | 1.0 | 1.0 | 1.0 | 1.0 | 1.0 | 1.0 | 1.0 | 1.0 |
| S100A9-MRM | 0.1 | 0.7 | 0.3 | 1.0 | 1.1 | 0.9 | 0.4 | 1.0 | 1.3 |
| S100A9-MRM | 0.1 | 0.7 | 1.1 | 1.7 | 1.8 | 0.9 | 0.5 | 1.3 | 1.4 |
| S100A9-MRM | 0.1 | 0.9 | 0.2 | 2.8 | 0.8 | 0.9 | 0.6 | 2.1 | 0.7 |
| PRD-MRM | 1.0 | 1.0 | 1.0 | 1.0 | 1.0 | 1.0 | 1.0 | 1.0 | 1.0 |
| PRD-MRM | 0.2 | 1.6 | 0.8 | 2.4 | 1.2 | 4.1 | 0.3 | 1.5 | 0.9 |
| PRD-MRM | 0.3 | 0.7 | 5.4 | 1.7 | 5.6 | 1.3 | 1.0 | 0.9 | 1.4 |
| PRD-MRM | 0.3 | 0.8 | 3.5 | 4.6 | 1.4 | 4.3 | 0.7 | 1.2 | 1.4 |
| S100A9/A8-ELISA | 1.0 | 1.0 | 1.0 | 1.0 | 1.0 | 1.0 | 1.0 | 1.0 | 1.0 |
| S100A9/A8-ELISA | 0.1 | 0.7 | 0.5 | 0.7 | 1.4 | 1.0 | 0.5 | 0.9 | 1.3 |
| S100A9/A8-ELISA | 0.1 | 0.9 | 0.4 | 0.9 | 1.9 | 0.9 | 0.8 | 0.5 | 1.5 |
| S100A9/A8-ELISA | 0.1 | 1.3 | 0.6 | 1.1 | 1.6 | 1.0 | 0.8 | 0.6 | 1.2 |
| | 0.3 | 1.0 | 0.6 | 0.9 | 1.5 | 1.0 | 0.8 | 0.8 | 1.2 |
| Lactoferrin-ELISA | 1.0 | 1.0 | 1.0 | 1.0 | 1.0 | 1.0 | 1.0 | 1.0 | 1.0 |
| Lactoferrin-ELISA | 0.1 | 0.8 | 0.4 | 1.1 | 0.3 | 0.5 | 0.6 | 0.9 | 1.1 |
| Lactoferrin-ELISA | 0.1 | 0.9 | 0.3 | 1.6 | 0.4 | 0.9 | 0.6 | 0.8 | 1.5 |
| Lactoferrin-ELISA | 0.1 | 0.9 | 0.6 | 1.6 | 0.7 | 0.9 | 0.7 | 2.2 | 0.7 |

Example 2: Detailed MRM method to measure 7 markers (Angiogenin (ANG), Extracellular matrix protein (ECM1), Long palate, lung and nasal epithelium carcinoma-1 (LPLUNC1), lactotransferrin (LTF), Lumican (LUM), S100A9, Peroxiredoxin (PRD, PRDX2 or PRD2) and workflow control: Beta-gal protein with three peptides. It is understood that various embodiments of the present invention include performing the MRM described in this Example 2 including analyzing one or more of the peptides described herein, recited transitions, as well as using the parameters described herein. One of ordinary skill in the art can perform the method of Example 2 without undue experimentation.

| File Information for Sample 24 (STD 100_2) of 20110523-STD.wiff | |
|---|---|
| File Name: | 20110523-STD.wiff |
| File Path: | C: \Analyst Data\Projects\Ischemia\Data\ |
| Original Name: | 20110523-STD.wiff |
| Software Version: | Analyst 1.5.1 |
| Log Information from Devices at Start of acquisition: Software Application MPX Driver 0 | |
| Time from start = 0.0000 min MPX Driver User = JVELABFFW\ Computer = JVELABFFW | |
| System Info. | |
| Current Stream | 1 |
| Oven Temp. | 36 |
| Autosampler Vendor | Shimadzu |
| Loading Pump Type | Single Solvent Selection |
| Online SPE | No |
| Stream 1 Info. | |
| Flow Rate | 0.2 uL/min |
| % B | 2% |

-continued

| | |
|---|---|
| Pump A Pressure | 1362.77 (psi) |
| Pump B Pressure | 1359.00 (psi) |
| Cooler Temp. | 15.01 degrees Celsius |
| Rack Changer Temp. | −1 degrees Celsius |

Stream 2 Info.

| | |
|---|---|
| Flow Rate | 0.2 uL/min |
| % B | 2% |
| Pump A Pressure | 1349.87 (psi) |
| Pump B Pressure | 1327.68 (psi) |
| Cooler Temp. | 14.98 degrees Celsius |
| Rack Changer Temp. | −1 degrees Celsius |
| Time from start = 0.0000 min Mass Spectrometer QTRAP 5500 0 | |
| Config Table Version | 01 |
| Firmware Version | ------- ------- PIL0102 PIB0101 |
| Component Name | Linear Ion Trap Quadrupole LC/MS/MS Mass Spectrometer |
| Component ID | QTRAP 5500 |
| Manufacturer | AB Sciex Instruments |
| Model | 1024945-AC |
| Serial Number | AU23121005 |
| Time from start = 0.0167 min Mass Spectrometer QTRAP 5500 0 | |

Start of Run—Detailed Status

| | |
|---|---|
| Vacuum Status | At Pressure |
| Vacuum Gauge (10e−5 Torr) | 2.8 |
| Backing Pump | Ok |
| Interface Pump | Bad |
| Curtain Gas | Bad |
| Interface Turbo Pump | Normal |
| Analyzer Turbo Pump | Off |
| Sample Introduction Status | Ready |
| Source/Ion Path Electronics | On |
| Source Type | Turbo Spray |
| Source Temperature (at setpoint) | 500.0 C. |
| Source Exhaust Pump | On |
| Injection Manifold | Bypass |
| Time from start = 0.0167 min Mass Spectrometer QTRAP 5500 0 | |

End of Run—Detailed Status

| | |
|---|---|
| Vacuum Status | At Pressure |
| Vacuum Gauge (10e−5 Torr) | 2.8 |
| Backing Pump | Ok |
| Interface Pump | Bad |
| Curtain Gas | Bad |
| Interface Turbo Pump | Normal |
| Analyzer Turbo Pump | Off |
| Sample Introduction Status | Ready |
| Source/Ion Path Electronics | On |
| Source Type | Turbo Spray |
| Source Temperature (at setpoint) | 500.0 C. |
| Source Exhaust Pump | On |
| Injection Manifold | Bypass |
| Time from start = 26.6000 min | |

Acquisition Info

| | |
|---|---|
| Acquisition Method: | \ischemia_Sch_1.dam |
| Acquisition Path: | D:\Analyst Data\Projects\JVE\Ischemia\Acquisition Methods\ |
| First Sample Started: | Monday, May 23, 2011 3:53:45 PM |
| Last Sample Finished: | Tuesday, May 24, 2011 5:39:25 AM |
| Sample Acq Time: | Tuesday, May 24, 2011 2:06:17 AM |
| Sample Acq Duration: | 26 min 0 sec |
| Number of Scans: | 0 |
| Periods in File: | 1 |
| Batch Name: | \20110523-STD.dab |
| Batch Path: | D:\Analyst Data\Projects\JVE\Ischemia\Batch\ |
| Submitted by: | JVELABFFW\Administrator( ) |
| Logged-on User: | JVELABFFW\Administrator |
| Synchronization Mode: | LC Sync |
| Auto-Equilibration: | Off |
| Comment: | Column: Waters: XBridge BEH130 C18 3.5 um |
| | 100 × 2.1 mm A: H2O/0.1% FA B: ACN/0.1% FA |
| Software Version: | Analyst 1.5.1 |
| Set Name: | 20110523-STD |
| Sample Name | STD 100_2 |

Sample ID
Sample Comments:

| | |
|---|---|
| Autosampler Vial: | 18 |
| Rack Code: | 1.5 mL Cooled |

-continued

| | |
|---|---|
| Rack Position: | 1 |
| Plate Code: | 1.5 mL Cooled |
| Plate Position | 1 |

Software Application Properties

| | |
|---|---|
| Display Name: | MPX Driver |
| Identifier Key: | {5EFDDCE0-DE4E-47FC-BF24-A45EB700B648} |
| Method Filename: | None |

Method Data:
Stream Options

| | |
|---|---|
| Inject Sample on Stream Number: | 1 |

Loading Pump

| | |
|---|---|
| Loading Pump Flow Rate: | 0.2 mL/min |
| Sample Equilibration Duration: | 5 sec |
| Sample Equilibration Channel: | A |
| Sample Loading Duration: | 5 sec |
| Sample Loading Channel: | A |

Sample Handling

| | |
|---|---|
| Default Injection Volume: | 5 uL |
| Cooling Enabled: | Yes |
| Cooling Temperature Set Point: | 15 degrees Celsius |
| Needle Stroke: | 2 mm |

Gradient Pump

Gradient Table

| | | |
|---|---|---|
| 0 | 2 | 0.2 |
| 1 | 2 | 0.2 |
| 12 | 35 | 0.2 |
| 15 | 35 | 0.2 |
| 15.5 | 90 | 0.3 |
| 18 | 90 | 0.3 |
| 18.5 | 2 | 0.2 |
| 26 | 2 | 0.2 |

Column Oven

| | |
|---|---|
| Oven Set Point: | 36 degrees Celsius |

Acquisition Window

| | |
|---|---|
| Start Time: | 0 min. |
| End Time: | 26 min. |

Other Options

| | |
|---|---|
| Wash Type: | Normal wash |
| Needle Dip Time: | 2 sec |
| AutoSampler Rinse Volume: | 500 uL |
| AutoSampler Rinse Speed: | 35 uL/sec |
| AutoSampler Rinse Mode: | 2 |
| Sampling Speed: | 5 uL/sec |
| Error Recovery Policy: | Continue running other streams and abort samples on the failed stream. |

Valco Valve Diverter

| Total | Time (min) | Position |
|---|---|---|
| 1 | 0.1 | A |

Quantitation Information:

| | |
|---|---|
| Sample Type: | Unknown |
| Dilution Factor: | 1.000000 |

Custom Data:
Quantitation Table:
Period 1:

| | |
|---|---|
| Scans in Period: | 1560 |
| Relative Start Time: | 0.00 msec |
| Experiments in Period: | 1 |

Period 1 Experiment 1:

| | |
|---|---|
| Scan Type: | MRM (MRM) |
| Scheduled MRM: | Yes |
| Polarity: | Positive |
| Scan Mode: | N/A |

-continued

| | |
|---|---|
| Ion Source: | Turbo Spray |
| MRM detection window: | 90 sec |
| Target Scan Time: | 1.0000 sec |
| Resolution Q1: | Unit |
| Resolution Q3: | Unit |
| Intensity Thres.: | 0.00 cps |
| Settling Time: | 0.0000 msec |
| MR Pause: | 5.0070 msec |
| MCA: | No |
| Step Size: | 0.00 Da |

| Q1 Mass (Da) | Q3 Mass (Da) | Time (min) | Param | Start | Stop | ID |
|---|---|---|---|---|---|---|
| 732.200 | 647.100 | 7.90 | CE | 37.00 | 37.00 | h_S100 A9 −1: LGHPDTLNQGEFK (SEQ ID NO: 1247)^_y11 (+2) |
| | | | CXP | 18.00 | 18.00 | |
| 732.200 | 1156.200 | 7.90 | CE | 37.00 | 37.00 | h_S100 A9 −1: LGHPDTLNQGEFK (SEQ ID NO: 1247)^_y10 |
| | | | CXP | 30.00 | 30.00 | |
| 732.200 | 302.100 | 7.90 | CE | 43.00 | 43.00 | h_S100 A9 −1: LGHPDTLNQGEFK (SEQ ID NO: 1247)^_y2 |
| | | | CXP | 26.00 | 26.00 | |
| 605.600 | 794.200 | 12.00 | CE | 23.00 | 23.00 | h_S100 A9 −2: NIETIINTFHQYSVK (SEQ ID NO: 1248)^_y13(+2) |
| | | | CXP | 22.00 | 22.00 | |
| 605.600 | 729.700 | 12.00 | CE | 25.00 | 25.00 | h_S100 A9 −2: NIETIINTFHQYSVK (SEQ ID NO: 1248)^_y12(+2) |
| | | | CXP | 20.00 | 20.00 | |
| 605.600 | 599.600 | 12.00 | CE | 23.00 | 23.00 | h_S100 A9 −2: NIETIINTFHQYSVK (SEQ ID NO: 1248)^_NTFHQ (SEQ ID NO: 1348)-28 |
| | | | CXP | 16.00 | 16.00 | |
| 490.100 | 765.100 | 6.90 | CE | 25.00 | 25.00 | h_S100 A9 −3: LTWASHEK (SEQ ID NO: 1249)^_y6 |
| | | | CXP | 20.00 | 20.00 | |
| 490.100 | 579.100 | 6.90 | CE | 29.00 | 29.00 | h_S100 A9 −3: LTWASHEK (SEQ ID NO: 1249)^_y5 |
| | | | CXP | 16.00 | 16.00 | |
| 490.100 | 481.000 | 6.90 | CE | 23.00 | 23.00 | h_S100 A9 −3: LTWASHEK (SEQ ID NO: 1249)^_MH-NH3 (+2) |
| | | | CXP | 12.00 | 12.00 | |
| 554.100 | 781.100 | 9.10 | CE | 27.00 | 27.00 | h_LTF −1: YYGYTGAFR (SEQ ID NO: 1250)^_y7 |
| | | | CXP | 20.00 | 20.00 | |
| 554.100 | 561.100 | 9.10 | CE | 27.00 | 27.00 | h_LTF −1: YYGYTGAFR (SEQ ID NO: 1250)^_y5 |
| | | | CXP | 16.00 | 16.00 | |
| 554.100 | 944.100 | 9.10 | CE | 31.00 | 31.00 | h_LTF −1: YYGYTGAFR (SEQ ID NO: 1250)^_y8 |
| | | | CXP | 26.00 | 26.00 | |
| 772.900 | 634.700 | 11.10 | CE | 35.00 | 35.00 | h_LTF −2: YLGPQYVAGITNLK (SEQ ID NO: 1251)^_y12 (+2) |
| | | | CXP | 16.00 | 16.00 | |
| 772.900 | 606.200 | 11.10 | CE | 37.00 | 37.00 | h_LTF −2: YLGPQYVAGITNLK (SEQ ID NO: 1251)^_y11 (+2) |
| | | | CXP | 16.00 | 16.00 | |
| 772.900 | 724.100 | 11.10 | CE | 41.00 | 41.00 | h_LTF −2: YLGPQYVAGITNLK (SEQ ID NO: 1251)^_y7 |
| | | | CXP | 20.00 | 20.00 | |
| 735.800 | 1202.200 | 8.10 | CE | 45.00 | 45.00 | h_LTF −3: LRPVAAEVYGTER (SEQ ID NO: 1252)^_y11 |
| | | | CXP | 32.00 | 32.00 | |
| 735.800 | 468.100 | 8.10 | CE | 57.00 | 57.00 | h_LTF −3: LRPVAAEVYGTER (SEQ ID NO: 1252)^_PVAAE (SEQ ID NO: 1349) |
| | | | CXP | 36.00 | 36.00 | |
| 735.800 | 1005.000 | 8.10 | CE | 51.00 | 51.00 | h_LTF −3: LRPVAAEVYGTER (SEQ ID NO: 1252)^_y9 |
| | | | CXP | 26.00 | 26.00 | |
| 490.700 | 682.100 | 6.90 | CE | 27.00 | 27.00 | h_PRD −1: IGKPAPDFK (SEQ ID NO: 1253)^_y6 |
| | | | CXP | 20.00 | 20.00 | |

| | | | | | | |
|---|---|---|---|---|---|---|
| 490.700 | 302.100 | 6.90 | CE | 27.00 | 27.00 | h_PRD -1: IGKPAPDFK (SEQ ID NO: 1253)^_y2 |
| | | | CXP | 28.00 | 28.00 | |
| 490.700 | 514.200 | 6.90 | CE | 33.00 | 33.00 | h_PRD -1: IGKPAPDFK (SEQ ID NO: 1253)^_y4 |
| | | | CXP | 16.00 | 16.00 | |
| 516.100 | 918.100 | 8.80 | CE | 25.00 | 25.00 | h_PRD -2: LSEDYGVLK (SEQ ID NO: 1254)^_y8 |
| | | | CXP | 26.00 | 26.00 | |
| 516.100 | 831.100 | 8.80 | CE | 23.00 | 23.00 | h_PRD -2: LSEDYGVLK (SEQ ID NO: 1254)^_y7 |
| | | | CXP | 24.00 | 24.00 | |
| 516.100 | 507.100 | 8.80 | CE | 21.00 | 21.00 | h_PRD -2: LSEDYGVLK (SEQ ID NO: 1254)^_MH-H2O (+2) |
| | | | CXP | 14.00 | 14.00 | |
| 467.600 | 419.000 | 6.90 | CE | 23.00 | 23.00 | h_PRD -3: TDEGIAYR (SEQ ID NO: 1255)^_y3 |
| | | | CXP | 12.00 | 12.00 | |
| 467.600 | 718.100 | 6.90 | CE | 23.00 | 23.00 | h_PRD -3: TDEGIAYR (SEQ ID NO: 1255)^_y6 |
| | | | CXP | 20.00 | 20.00 | |
| 467.600 | 589.100 | 6.90 | CE | 25.00 | 25.00 | h_PRD -3: TDEGIAYR (SEQ ID NO: 1255)^_y5 |
| | | | CXP | 16.00 | 16.00 | |
| 617.200 | 806.100 | 9.90 | CE | 27.00 | 27.00 | h_LUM -1: ISNIPDEYFK (SEQ ID NO: 1256)^_y6 |
| | | | CXP | 22.00 | 22.00 | |
| 617.200 | 315.000 | 9.90 | CE | 29.00 | 29.00 | h_LUM -1: ISNIPDEYFK (SEQ ID NO: 1256)^_b3 |
| | | | CXP | 28.00 | 28.00 | |
| 617.200 | 428.100 | 9.90 | CE | 23.00 | 23.00 | h_LUM -1: ISNIPDEYFK (SEQ ID NO: 1256)^_b4 |
| | | | CXP | 12.00 | 12.00 | |
| 517.600 | 262.000 | 11.20 | CE | 25.00 | 25.00 | h_LUM -2: FNALQYLR (SEQ ID NO: 1257)^_b2 |
| | | | CXP | 24.00 | 24.00 | |
| 517.600 | 589.100 | 11.20 | CE | 27.00 | 27.00 | h_LUM -2: FNALQYLR (SEQ ID NO: 1257)^_y4 |
| | | | CXP | 16.00 | 16.00 | |
| 517.600 | 773.200 | 11.20 | CE | 25.00 | 25.00 | h_LUM -2: FNALQYLR (SEQ ID NO: 1257)^_y6 |
| | | | CXP | 22.00 | 22.00 | |
| 653.300 | 553.300 | 8.60 | CE | 32.00 | 32.00 | h_LUM -3: SLEDLQLTHNK (SEQ ID NO: 1258)^_y9 (+2) |
| | | | CXP | 15.00 | 15.00 | |
| 653.300 | 445.200 | 8.60 | CE | 35.00 | 35.00 | h_LUM -3: SLEDLQLTHNK (SEQ ID NO: 1258)^_b4 |
| | | | CXP | 14.00 | 14.00 | |
| 653.300 | 406.200 | 8.60 | CE | 43.00 | 43.00 | h_LUM -3: SLEDLQLTHNK (SEQ ID NO: 1258)^_y3 |
| | | | CXP | 12.00 | 12.00 | |
| 503.100 | 674.000 | 6.80 | CE | 25.00 | 25.00 | h_ECM -1: APYPNYDR (SEQ ID NO: 1259)^_y5 |
| | | | CXP | 18.00 | 18.00 | |
| 503.100 | 233.000 | 6.80 | CE | 33.00 | 33.00 | h_ECM -1: APYPNYDR (SEQ ID NO: 1259)^_YP-28 |
| | | | CXP | 20.00 | 20.00 | |
| 503.100 | 467.600 | 6.80 | CE | 25.00 | 25.00 | h_ECM -1: APYPNYDR (SEQ ID NO: 1259)^_y7 (+2) |
| | | | CXP | 14.00 | 14.00 | |
| 476.500 | 395.600 | 7.60 | CE | 19.00 | 19.00 | h_ECM -2: ELPSLQHPNEQK (SEQ ID NO: 1260)^_y10 (+3) |
| | | | CXP | 10.00 | 10.00 | |
| 476.500 | 593.100 | 7.60 | CE | 21.00 | 21.00 | h_ECM -2: ELPSLQHPNEQK (SEQ ID NO: 1260)^_y10 (+2) |
| | | | CXP | 16.00 | 16.00 | |
| 476.500 | 544.700 | 7.60 | CE | 25.00 | 25.00 | h_ECM -2: ELPSLQHPNEQK (SEQ ID NO: 1260)^_y9 (+2) |
| | | | CXP | 14.00 | 14.00 | |
| 544.200 | 431.100 | 9.20 | CE | 23.00 | 23.00 | h_ECM -3: LLPAQLPAEK (SEQ ID NO: 1261)^_y8 (+2) |
| | | | CXP | 12.00 | 12.00 | |
| 544.200 | 452.000 | 9.20 | CE | 39.00 | 39.00 | h_ECM -3: LLPAQLPAEK (SEQ ID NO: 1261)^_y4 |
| | | | CXP | 14.00 | 14.00 | |
| 544.200 | 861.100 | 9.20 | CE | 25.00 | 25.00 | h_ECM -3: LLPAQLPAEK (SEQ ID NO: 1261)^_y8 |
| | | | CXP | 24.00 | 24.00 | |

-continued

| | | | | | | |
|---|---|---|---|---|---|---|
| 666.200 | 1147.100 | 10.20 | CE | 31.00 | 31.00 | h_LPLUNC1 -1: ALGFEAAESSLTK (SEQ ID NO: 1262)^_y11 |
| | | | CXP | 30.00 | 30.00 | |
| 666.200 | 814.100 | 10.20 | CE | 33.00 | 33.00 | h_LPLUNC1 -1: ALGFEAAESSLTK (SEQ ID NO: 1262)^_y8 |
| | | | CXP | 22.00 | 22.00 | |
| 666.200 | 943.100 | 10.20 | CE | 33.00 | 33.00 | h_LPLUNC1 -1: ALGFEAAESSLTK (SEQ ID NO: 1262)^_y9 |
| | | | CXP | 26.00 | 26.00 | |
| 665.300 | 242.900 | 13.40 | CE | 29.00 | 29.00 | h_LPLUNC1 -2: LEFDLLYPAIK (SEQ ID NO: 1263)^_b2 |
| | | | CXP | 20.00 | 20.00 | |
| 665.300 | 436.100 | 13.40 | CE | 41.00 | 41.00 | h_LPLUNC1 -2: LEFDLLYPAIK (SEQ ID NO: 1263)^_y4 |
| | | | CXP | 38.00 | 38.00 | |
| 665.300 | 599.000 | 13.40 | CE | 27.00 | 27.00 | h_LPLUNC1 -2: LEFDLLYPAIK (SEQ ID NO: 1263)^_y5 |
| | | | CXP | 16.00 | 16.00 | |
| 427.100 | 418.100 | 7.20 | CE | 19.00 | 19.00 | h_LPLUNC1 -3: LGSTQIVK (SEQ ID NO: 1264)^_MH-H2O (+2) |
| | | | CXP | 12.00 | 12.00 | |
| 427.100 | 740.100 | 7.20 | CE | 21.00 | 21.00 | h_LPLUNC1 -3: LGSTQIVK (SEQ ID NO: 1264)^_y7 |
| | | | CXP | 20.00 | 20.00 | |
| 427.100 | 683.100 | 7.20 | CE | 21.00 | 21.00 | h_LPLUNC1 -3: LGSTQIVK (SEQ ID NO: 1264)^_y6 |
| | | | CXP | 20.00 | 20.00 | |
| 583.600 | 938.200 | 9.00 | CE | 31.00 | 31.00 | h_ANG -1: DINTFIHGNK (SEQ ID NO: 1265)^_y8 |
| | | | CXP | 26.00 | 26.00 | |
| 583.600 | 463.000 | 9.00 | CE | 39.00 | 39.00 | h_ANG -1: DINTFIHGNK (SEQ ID NO: 1265)^_y4 |
| | | | CXP | 40.00 | 40.00 | |
| 583.600 | 723.000 | 9.00 | CE | 33.00 | 33.00 | h_ANG -1: DINTFIHGNK (SEQ ID NO: 1265)^_y6 |
| | | | CXP | 20.00 | 20.00 | |
| 493.700 | 467.000 | 7.20 | CE | 29.00 | 29.00 | h_ANG -2: YTHFLTQHYDAKPQGR (SEQ ID NO: 1266)^_y4 |
| | | | CXP | 38.00 | 38.00 | |
| 493.700 | 569.700 | 7.20 | CE | 23.00 | 23.00 | h_ANG -2: YTHFLTQHYDAKPQGR (SEQ ID NO: 1266)^_y14 (+3) |
| | | | CXP | 6.00 | 6.00 | |
| 493.700 | 472.600 | 7.20 | CE | 25.00 | 25.00 | h_ANG -2: YTHFLTQHYDAKPQGR (SEQ ID NO: 1266)^_y8 (+2) |
| | | | CXP | 12.00 | 12.00 | |
| 404.100 | 350.100 | 7.20 | CE | 13.00 | 13.00 | h_SEMG -1: GHYQNVVEVR (SEQ ID NO: 1267)^_b6 (+2) |
| | | | CXP | 10.00 | 10.00 | |
| 404.100 | 512.100 | 7.20 | CE | 15.00 | 15.00 | h_SEMG -1: GHYQNVVEVR (SEQ ID NO: 1267)^_y4 |
| | | | CXP | 42.00 | 42.00 | |
| 404.100 | 336.100 | 7.20 | CE | 15.00 | 15.00 | h_SEMG -1: GHYQNVVEVR (SEQ ID NO: 1267)^_a6 (+2) |
| | | | CXP | 10.00 | 10.00 | |
| 755.300 | 698.700 | 9.10 | CE | 39.00 | 39.00 | h_SEMG -2: LPSEFSQFPHGQK (SEQ ID NO: 1268)^_y12 (+2) |
| | | | CXP | 18.00 | 18.00 | |
| 755.300 | 574.000 | 9.10 | CE | 47.00 | 47.00 | h_SEMG -2: LPSEFSQFPHGQK (SEQ ID NO: 1268)^_y5 |
| | | | CXP | 16.00 | 16.00 | |
| 755.300 | 936.100 | 9.10 | CE | 41.00 | 41.00 | h_SEMG -2: LPSEFSQFPHGQK (SEQ ID NO: 1268)^_y8 |
| | | | CXP | 24.00 | 24.00 | |
| 846.900 | 432.100 | 11.80 | CE | 33.00 | 33.00 | h_SEMG -3: DIFSTQDELLVYNK (SEQ ID NO: 1269)^_y3 |
| | | | CXP | 12.00 | 12.00 | |

-continued

| | | | | | | |
|---|---|---|---|---|---|---|
| 846.900 | 732.800 | 11.80 | CE | 33.00 | 33.00 | h_SEMG −3: DIFSTQDELLVYNK (SEQ ID NO: 1269)^_y12 (+2) |
| 846.900 | 531.100 | 11.80 | CXP | 20.00 | 20.00 | |
| | | | CE | 35.00 | 35.00 | h_SEMG −3: DIFSTQDELLVYNK (SEQ ID NO: 1269)^_y4 |
| 728.400 | 643.300 | 7.90 | CXP | 48.00 | 48.00 | |
| | | | CE | 37.00 | 37.00 | 1_S100 A9 −1: LGHPDTLNQGEFK (SEQ ID NO: 1247)_y11 (+2) |
| 728.400 | 1148.500 | 7.90 | CXP | 18.00 | 18.00 | |
| | | | CE | 37.00 | 37.00 | 1_S100 A9 −1: LGHPDTLNQGEFK (SEQ ID NO: 1247)_y10 |
| 728.400 | 294.200 | 7.90 | CXP | 30.00 | 30.00 | |
| | | | CE | 43.00 | 43.00 | 1_S100 A9 −1: LGHPDTLNQGEFK (SEQ ID NO: 1247)_y2 |
| 603.000 | 790.400 | 12.00 | CXP | 26.00 | 26.00 | |
| | | | CE | 23.00 | 23.00 | 1_S100 A9 −2: NIETIINTFHQYSVK (SEQ ID NO: 1248)_y13(+2) |
| 603.000 | 725.800 | 12.00 | CXP | 22.00 | 22.00 | |
| | | | CE | 25.00 | 25.00 | 1_S100 A9 −2: NIETIINTFHQYSVK (SEQ ID NO: 1248)_y12(+2) |
| 603.000 | 599.600 | 12.00 | CXP | 20.00 | 20.00 | |
| | | | CE | 23.00 | 23.00 | 1_S100 A9 −2: NIETIINTFHQYSVK (SEQ ID NO: 1248)_NTFHQ (SEQ ID NO: 1348)-28 |
| 486.200 | 757.300 | 6.90 | CXP | 16.00 | 16.00 | |
| | | | CE | 25.00 | 25.00 | 1_S100 A9 −3: LTWASHEK (SEQ ID NO: 1249)_y6 |
| 486.200 | 571.200 | 6.90 | CXP | 20.00 | 20.00 | |
| | | | CE | 29.00 | 29.00 | 1_S100 A9 −3: LTWASHEK (SEQ ID NO: 1249)_y5 |
| 486.200 | 477.200 | 6.90 | CXP | 16.00 | 16.00 | |
| | | | CE | 23.00 | 23.00 | 1_S100 A9 −3: LTWASHEK (SEQ ID NO: 1249)_MH_NH3(+2) |
| 549.200 | 771.300 | 9.10 | CXP | 12.00 | 12.00 | |
| | | | CE | 27.00 | 27.00 | 1_LTF −1: YYGYTGAFR (SEQ ID NO: 1250)_y7 |
| 549.200 | 551.200 | 9.10 | CXP | 20.00 | 20.00 | |
| | | | CE | 27.00 | 27.00 | 1_LTF −1: YYGYTGAFR (SEQ ID NO: 1250)_y5 |
| 549.200 | 934.400 | 9.10 | CXP | 16.00 | 16.00 | |
| | | | CE | 31.00 | 31.00 | 1_LTF −1: YYGYTGAFR (SEQ ID NO: 1250)_y8 |
| 768.900 | 630.800 | 11.10 | CXP | 26.00 | 26.00 | |
| | | | CE | 35.00 | 35.00 | 1_LTF −2: YLGPQYVAGITNLK (SEQ ID NO: 1251)_y12 (+2) |
| 768.900 | 602.300 | 11.10 | CXP | 16.00 | 16.00 | |
| | | | CE | 37.00 | 37.00 | 1_LTF −2: YLGPQYVAGITNLK (SEQ ID NO: 1251)_y11 (+2) |
| 768.900 | 716.400 | 11.10 | CXP | 16.00 | 16.00 | |
| | | | CE | 41.00 | 41.00 | 1_LTF −2: YLGPQYVAGITNLK (SEQ ID NO: 1251)_y7 |
| 730.800 | 1191.600 | 8.10 | CXP | 20.00 | 20.00 | |
| | | | CE | 45.00 | 45.00 | 1_LTF −3: LRPVAAEVYGTER (SEQ ID NO: 1252)_y11 |
| 730.800 | 468.100 | 8.10 | CXP | 32.00 | 32.00 | |
| | | | CE | 57.00 | 57.00 | 1_LTF −3: LRPVAAEVYGTER (SEQ ID NO: 1252)_PVAAE (SEQ ID NO: 1349) |
| 730.800 | 995.400 | 8.10 | CXP | 36.00 | 36.00 | |
| | | | CE | 51.00 | 51.00 | 1_LTF −3: LRPVAAEVYGTER (SEQ ID NO: 1252)_y9 |
| 486.700 | 674.300 | 6.90 | CXP | 26.00 | 26.00 | |
| | | | CE | 27.00 | 27.00 | 1_PRD −1: IGKPAPDFK (SEQ ID NO: 1253)_y6 |
| 486.700 | 294.200 | 6.90 | CXP | 20.00 | 20.00 | |
| | | | CE | 27.00 | 27.00 | 1_PRD −1: IGKPAPDFK (SEQ ID NO: 1253)_y2 |
| 486.700 | 506.200 | 6.90 | CXP | 28.00 | 28.00 | |
| | | | CE | 33.00 | 33.00 | 1_PRD −1: IGKPAPDFK (SEQ ID NO: 1253)_y4 |
| | | | CXP | 16.00 | 16.00 | |

-continued

| | | | | | | |
|---|---|---|---|---|---|---|
| 512.200 | 910.400 | 8.80 | CE | 25.00 | 25.00 | 1_PRD -2: LSEDYGVLK (SEQ ID NO: 1254)_y8 |
| | | | CXP | 26.00 | 26.00 | |
| 512.200 | 823.400 | 8.80 | CE | 23.00 | 23.00 | 1_PRD -2: LSEDYGVLK (SEQ ID NO: 1254)_y7 |
| | | | CXP | 24.00 | 24.00 | |
| 512.200 | 503.200 | 8.80 | CE | 21.00 | 21.00 | 1_PRD -2: LSEDYGVLK (SEQ ID NO: 1254)_MH-H2O (+2) |
| | | | CXP | 14.00 | 14.00 | |
| 462.700 | 409.200 | 6.90 | CE | 23.00 | 23.00 | 1_PRD -3: TDEGIAYR (SEQ ID NO: 1255)_y3 |
| | | | CXP | 12.00 | 12.00 | |
| 462.700 | 708.300 | 6.90 | CE | 23.00 | 23.00 | 1_PRD -3: TDEGIAYR (SEQ ID NO: 1255)_y6 |
| | | | CXP | 20.00 | 20.00 | |
| 462.700 | 579.300 | 6.90 | CE | 25.00 | 25.00 | 1_PRD -3: TDEGIAYR (SEQ ID NO: 1255)_y5 |
| | | | CXP | 16.00 | 16.00 | |
| 613.300 | 798.300 | 9.90 | CE | 27.00 | 27.00 | 1_LUM -1: ISNIPDEYFK (SEQ ID NO: 1256)_y6 |
| | | | CXP | 22.00 | 22.00 | |
| 613.300 | 315.000 | 9.90 | CE | 29.00 | 29.00 | 1_LUM -1: ISNIPDEYFK (SEQ ID NO: 1256)_b3 |
| | | | CXP | 28.00 | 28.00 | |
| 613.300 | 428.100 | 9.90 | CE | 23.00 | 23.00 | 1_LUM -1: ISNIPDEYFK (SEQ ID NO: 1256)_b4 |
| | | | CXP | 12.00 | 12.00 | |
| 512.700 | 262.000 | 11.20 | CE | 25.00 | 25.00 | 1_LUM -2: FNALQYLR (SEQ ID NO: 1257)_b2 |
| | | | CXP | 24.00 | 24.00 | |
| 512.700 | 579.300 | 11.20 | CE | 27.00 | 27.00 | 1_LUM -2: FNALQYLR (SEQ ID NO: 1257)_y4 |
| | | | CXP | 16.00 | 16.00 | |
| 512.700 | 763.400 | 11.20 | CE | 25.00 | 25.00 | 1_LUM -2: FNALQYLR (SEQ ID NO: 1257)_y6 |
| | | | CXP | 22.00 | 22.00 | |
| 649.300 | 549.300 | 8.60 | CE | 32.00 | 32.00 | 1_LUM -3: SLEDLQLTHNK (SEQ ID NO: 1258)_y9 (+2) |
| | | | CXP | 15.00 | 15.00 | |
| 649.300 | 445.200 | 8.60 | CE | 35.00 | 35.00 | 1_LUM -3: SLEDLQLTHNK (SEQ ID NO: 1258)_b4 |
| | | | CXP | 14.00 | 14.00 | |
| 649.300 | 398.200 | 8.60 | CE | 43.00 | 43.00 | 1_LUM -3: SLEDLQLTHNK (SEQ ID NO: 1258)_y3 |
| | | | CXP | 12.00 | 12.00 | |
| 498.200 | 664.300 | 6.80 | CE | 25.00 | 25.00 | 1_ECM -1: APYPNYDR (SEQ ID NO: 1259)_y5 |
| | | | CXP | 18.00 | 18.00 | |
| 498.200 | 233.000 | 6.80 | CE | 33.00 | 33.00 | 1_ECM -1: APYPNYDR (SEQ ID NO: 1259)_YP-28 |
| | | | CXP | 20.00 | 20.00 | |
| 498.200 | 462.700 | 6.80 | CE | 25.00 | 25.00 | 1_ECM -1: APYPNYDR (SEQ ID NO: 1259)_y7 (+2) |
| | | | CXP | 14.00 | 14.00 | |
| 473.900 | 393.200 | 7.60 | CE | 19.00 | 19.00 | 1_ECM -2: ELPSLQHPNEQK (SEQ ID NO: 1260)_y10 (+3) |
| | | | CXP | 10.00 | 10.00 | |
| 473.900 | 589.300 | 7.60 | CE | 21.00 | 21.00 | 1_ECM -2: ELPSLQHPNEQK (SEQ ID NO: 1260)_y10 (+2) |
| | | | CXP | 16.00 | 16.00 | |
| 473.900 | 540.800 | 7.60 | CE | 25.00 | 25.00 | 1_ECM -2: ELPSLQHPNEQK (SEQ ID NO: 1260)_y9 (+2) |
| | | | CXP | 14.00 | 14.00 | |
| 540.300 | 427.200 | 9.20 | CE | 23.00 | 23.00 | 1_ECM -3: LLPAQLPAEK (SEQ ID NO: 1261)_y8 (+2) |
| | | | CXP | 12.00 | 12.00 | |
| 540.300 | 444.200 | 9.20 | CE | 39.00 | 39.00 | 1_ECM -3: LLPAQLPAEK (SEQ ID NO: 1261)_y4 |
| | | | CXP | 14.00 | 14.00 | |
| 540.300 | 853.400 | 9.20 | CE | 25.00 | 25.00 | 1_ECM -3: LLPAQLPAEK (SEQ ID NO: 1261)_y8 |
| | | | CXP | 24.00 | 24.00 | |
| 662.300 | 1139.500 | 10.20 | CE | 31.00 | 31.00 | 1_LPLUNC1 -1: ALGFEAAESSLTK (SEQ ID NO: 1262)_y11 |
| | | | CXP | 30.00 | 30.00 | |

-continued

| | | | | | | |
|---|---|---|---|---|---|---|
| 662.300 | 806.400 | 10.20 | CE | 33.00 | 33.00 | 1_LPLUNC1 -1: ALGFEAAESSLTK (SEQ ID NO: 1262)_y8 |
| | | | CXP | 22.00 | 22.00 | |
| 662.300 | 935.400 | 10.20 | CE | 33.00 | 33.00 | 1_LPLUNC1 -1: ALGFEAAESSLTK (SEQ ID NO: 1262)_y9 |
| | | | CXP | 26.00 | 26.00 | |
| 661.300 | 242.900 | 13.40 | CE | 29.00 | 29.00 | 1_LPLUNC1 -2: LEFDLLYPAIK (SEQ ID NO: 1263)_b2 |
| | | | CXP | 20.00 | 20.00 | |
| 661.300 | 428.200 | 13.40 | CE | 41.00 | 41.00 | 1_LPLUNC1 -2: LEFDLLYPAIK (SEQ ID NO: 1263)_y4 |
| | | | CXP | 38.00 | 38.00 | |
| 661.300 | 591.300 | 13.40 | CE | 27.00 | 27.00 | 1_LPLUNC1 -2: LEFDLLYPAIK (SEQ ID NO: 1263)_y5 |
| | | | CXP | 16.00 | 16.00 | |
| 423.200 | 414.200 | 7.20 | CE | 19.00 | 19.00 | 1_LPLUNC1 -3: LGSTQIVK (SEQ ID NO: 1264)_MH-H2O(+2) |
| | | | CXP | 12.00 | 12.00 | |
| 423.200 | 732.400 | 7.20 | CE | 21.00 | 21.00 | 1_LPLUNC1 -3: LGSTQIVK (SEQ ID NO: 1264)_y7 |
| | | | CXP | 20.00 | 20.00 | |
| 423.200 | 675.400 | 7.20 | CE | 21.00 | 21.00 | 1_LPLUNC1 -3: LGSTQIVK (SEQ ID NO: 1264)_y6 |
| | | | CXP | 20.00 | 20.00 | |
| 579.700 | 930.400 | 9.00 | CE | 31.00 | 31.00 | 1_ANG -1: DINTFIHGNK (SEQ ID NO: 1265)_y8 |
| | | | CXP | 26.00 | 26.00 | |
| 579.700 | 455.200 | 9.00 | CE | 39.00 | 39.00 | 1_ANG -1: DINTFIHGNK (SEQ ID NO: 1265)_y4 |
| | | | CXP | 40.00 | 40.00 | |
| 579.700 | 715.300 | 9.00 | CE | 33.00 | 33.00 | 1_ANG -1: DINTFIHGNK (SEQ ID NO: 1265)_y6 |
| | | | CXP | 20.00 | 20.00 | |
| 491.200 | 457.200 | 7.20 | CE | 29.00 | 29.00 | 1_ANG -2: YTHFLTQHYDAKPQGR (SEQ ID NO: 1266)_y4 |
| | | | CXP | 38.00 | 38.00 | |
| 491.200 | 566.600 | 7.20 | CE | 23.00 | 23.00 | 1_ANG -2: YTHFLTQHYDAKPQGR (SEQ ID NO: 1266)_y14 (+3) |
| | | | CXP | 6.00 | 6.00 | |
| 491.200 | 467.700 | 7.20 | CE | 25.00 | 25.00 | 1_ANG -2: YTHFLTQHYDAKPQGR (SEQ ID NO: 1266)_y8 (+2) |
| | | | CXP | 12.00 | 12.00 | |
| 400.800 | 350.100 | 7.20 | CE | 13.00 | 13.00 | 1_SEMG -1: GHYQNVVEVR (SEQ ID NO: 1267)_b6 (+2) |
| | | | CXP | 10.00 | 10.00 | |
| 400.800 | 502.200 | 7.20 | CE | 15.00 | 15.00 | 1_SEMG -1: GHYQNVVEVR (SEQ ID NO: 1267)_y4 |
| | | | CXP | 42.00 | 42.00 | |
| 400.800 | 336.100 | 7.20 | CE | 15.00 | 15.00 | 1_SEMG -1: GHYQNVVEVR (SEQ ID NO: 1267)_a6 (+2) |
| | | | CXP | 10.00 | 10.00 | |
| 751.300 | 694.800 | 9.10 | CE | 39.00 | 39.00 | 1_SEMG -2: LPSEFSQFPHGQK (SEQ ID NO: 1268)_y12 (+2) |
| | | | CXP | 18.00 | 18.00 | |
| 751.300 | 566.300 | 9.10 | CE | 47.00 | 47.00 | 1_SEMG -2: LPSEFSQFPHGQK (SEQ ID NO: 1268)_y5 |
| | | | CXP | 16.00 | 16.00 | |
| 751.300 | 928.400 | 9.10 | CE | 41.00 | 41.00 | 1_SEMG -2: LPSEFSQFPHGQK (SEQ ID NO: 1268)_y8 |
| | | | CXP | 24.00 | 24.00 | |
| 842.900 | 424.200 | 11.80 | CE | 33.00 | 33.00 | 1_SEMG -3: DIFSTQDELLVYNK (SEQ ID NO: 1269)_y3 |
| | | | CXP | 12.00 | 12.00 | |
| 842.900 | 728.800 | 11.80 | CE | 33.00 | 33.00 | 1_SEMG -3: DIFSTQDELLVYNK (SEQ ID NO: 1269)_y12 (+2) |
| | | | CXP | 20.00 | 20.00 | |
| 842.900 | 523.200 | 11.80 | CE | 35.00 | 35.00 | 1_SEMG -3: DIFSTQDELLVYNK (SEQ ID NO: 1269)_y4 |
| | | | CXP | 48.00 | 48.00 | |

| Parameter Table(Period 1 Experiment 1) | |
|---|---|
| CUR: | 30.00 |
| CAD: | Medium |
| IS: | 5000.00 |
| TEM: | 500.00 |
| GS1: | 40.00 |
| GS2: | 60.00 |
| DP | 80.00 |
| EP | 10.00 |

| Resolution tables | |
|---|---|
| Mass (Da) | Offset Value |
| Quad 1 Positive Unit Scan Speed = 10 Da/s Last Modification Date Time: Feb. 18, 2011 11:22:24 IE1 0.800 | |
| 59.050 | −0.230 |
| 175.133 | −0.585 |
| 500.380 | −1.650 |
| 616.464 | −2.035 |
| 906.673 | −2.995 |
| Quad 3 Positive Unit Scan Speed = 10 Da/s Last Modification Date Time: Feb. 16, 2011 11:01:41 1E3 0.900 | |
| 59.050 | −0.170 |
| 175.133 | −0.450 |
| 500.380 | −1.270 |
| 616.464 | −1.570 |
| 906.673 | −2.300 |

| Calibration tables | |
|---|---|
| Mass (Da) | Dac Value |
| Quad 1 Positive Unit Resolution Scan Speed = 10 Da/s Last Modification Date Time: Feb. 16, 2011 10:44:51 | |
| 59.050 | 10802 |
| 175.133 | 32387 |
| 500.380 | 92852 |
| 616.464 | 114432 |
| 906.673 | 168379 |
| Quad 3 Positive Unit Resolution Scan Speed = 10 Da/s Last Modification Date Time: Feb. 16, 2011 11:02:58 | |
| 59.050 | 10792 |
| 175.133 | 32315 |
| 500.380 | 92643 |
| 616.464 | 114175 |
| 906.673 | 167998 |

| Instrument Parameters: | |
|---|---|
| Detector Parameters (Positive): | CEM 2300.0 |
| Keyed Text: | File was created with the software version: Analyst 1.5.1 |

EXAMPLE 3: Detailed MRM method 2 to measure 8 markers (Apolipoprotein A-II (APOA2), Carbonic anhydrase 1 (CA1, also known as CAH), CD38 ADP-ribosyl cyclase/cyclic ADPribose hydrolase (CD38), Catalase (CATA or CAT), Matrix metalloproteinase-9 (MMP9), Isoform 2 of Neutrophil gelatinase associated lipocalin (NGAL2, also known as LCN2), S100-A7, S100-A8) and workflow control: Beta gal with three peptides). It is understood that various embodiments of the present invention include performing the MRM described in this Example 3 including analyzing one or more of the peptides described herein, recited transitions, as well as using the parameters described herein. One of ordinary skill in the art can perform the method of Example 3 without undue experimentation.

| File Information for Sample 13 (IS 013) of 20120410.wiff | |
|---|---|
| File Name: | 20120410.wiff |
| File Path: | C:\Analyst Data\Projects\UnipathII\Data\ |
| Original Name: | 20120410.wiff |
| Software Version: | Analyst 1.5.1 |
| Log Information from | Software Application MPX Driver 0 |

-continued

| | |
|---|---|
| Devices at Start of acquisition: | |
| Time from start = 0.0000 min MPX Driver User = JVELABFFW\ Computer = JVELABFFW | |

System Info.

| | |
|---|---|
| Current Stream | 1 |
| Oven Temp. | 36 |
| Autosampler Vendor | Shimadzu |
| Loading Pump Type | Single Solvent Selection |
| Online SPE | No |

Stream 1 Info.

| | |
|---|---|
| Flow Rate | 0.2 uL/min |
| % B | 2% |
| Pump A Pressure | 1436.74 (psi) |
| Pump B Pressure | 1421.95 (psi) |
| Cooler Temp. | 15.03 degrees Celsius |
| Rack Changer Temp. | −1 degrees Celsius |

Stream 2 Info.

| | |
|---|---|
| Flow Rate | 0.2 uL/min |
| % B | 2% |
| Pump A Pressure | 1360.89 (psi) |
| Pump B Pressure | 1323.90 (psi) |
| Cooler Temp. | 14.99 degrees Celsius |
| Rack Changer Temp. | −1 degrees Celsius |
| Time from start = 0.0167 min Mass Spectrometer QTRAP 5500 0 | |
| Config Table Version | 01 |
| Firmware Version | ------- ------- PIL0102 PIB0101 |
| Component Name | Linear Ion Trap Quadrupole LC/MS/MS Mass Spectrometer |
| Component ID | QTRAP 5500 |
| Manufacturer | AB Sciex Instruments |
| Model | 1024945-AC |
| Serial Number | AU23121005 |
| Time from start = 0.0167 min Mass Spectrometer QTRAP 5500 0 | |

Start of Run—Detailed Status

| | |
|---|---|
| Vacuum Status | At Pressure |
| Vacuum Gauge (10e−5 Torr) | 2.6 |
| Backing Pump | Ok |
| Interface Pump | Bad |
| Curtain Gas | Bad |
| Interface Turbo Pump | Normal |
| Analyzer Turbo Pump | Off |
| Sample Introduction Status | Ready |
| Source/Ion Path Electronics | On |
| Source Type | Turbo Spray |
| Source Temperature (at setpoint) | 500.0 C. |
| Source Exhaust Pump | On |
| Injection Manifold | Bypass |
| Time from start = 0.0167 min Mass Spectrometer QTRAP 5500 0 | |

End of Run—Detailed Status

| | |
|---|---|
| Vacuum Status | At Pressure |
| Vacuum Gauge (10e−5 Torr) | 2.6 |
| Backing Pump | Ok |
| Interface Pump | Bad |
| Curtain Gas | Bad |
| Interface Turbo Pump | Normal |
| Analyzer Turbo Pump | Off |
| Sample Introduction Status | Ready |
| Source/Ion Path Electronics | On |
| Source Type | Turbo Spray |
| Source Temperature (at setpoint) | 500.0 C. |
| Source Exhaust Pump | On |
| Injection Manifold | Bypass |
| Time from start = 28.6333 min | |

Acquisition Info

| | |
|---|---|
| Acquisition Method: | \UnipathII_28IS_1.dam |
| Acquisition Path: | D:\Analyst Data\Projects\JVE\UnipathII\Acquisition Methods\ |

-continued

| | |
|---|---|
| First Sample Started: | Tuesday, Apr. 10, 2012 2:49:29 PM |
| Last Sample Finished: | Tuesday, Apr. 10, 2012 9:30:17 PM |
| Sample Acq Time: | Tuesday, Apr. 10, 2012 8:33:00 PM |
| Sample Acq Duration: | 28 min 0 sec |
| Number of Scans: | 0 |
| Periods in File: | 1 |
| Batch Name: | \New Batch.dab |
| Batch Path: | D:\Analyst Data\Projects\JVE\UnipathII\Batch\ |
| Submitted by: | JVELABFFW\Administrator( ) |
| Logged-on User: | JVELABFFW\Administrator |
| Synchronization Mode: | LC Sync |
| Auto-Equilibration: | Off |
| Comment: | Column: Waters: XBridge BEH130 C18 3.5 um 100 × 2.1 mm A: H2O/0.1% FA B: ACN/0.1% FA |
| Software Version: | Analyst 1.5.1 |
| Set Name: | 20120410 |
| Sample Name | IS 013 |

Sample ID
Sample Comments:

| | |
|---|---|
| Autosampler Vial: | 70 |
| Rack Code: | 1.5 mL Cooled |

Rack Position: 1

| | |
|---|---|
| Plate Code: | 1.5 mL Cooled |
| Plate Position | 1 |

Software Application Properties

| | |
|---|---|
| Display Name: | MPX Driver |
| Identifier Key: | {5EFDDCE0-DE4E-47FC-BF24-A45EB700B648} |
| Method Filename: | None |

Method Data:
Stream Options

| | |
|---|---|
| Inject Sample on Stream Number: | 1 |

Loading Pump

| | |
|---|---|
| Loading Pump Flow Rate: | 0.2 mL/min |
| Sample Equilibration Duration: | 5 sec |
| Sample Equilibration Channel: | A |
| Sample Loading Duration: | 5 sec |
| Sample Loading Channel: | A |

Sample Handling

| | |
|---|---|
| Default Injection Volume: | 10 uL |
| Cooling Enabled: | Yes |
| Cooling Temperature Set Point: | 15 degrees Celsius |
| Needle Stroke: | 2 mm |

Gradient Pump

Gradient Table

| | | |
|---|---|---|
| 0 | 2 | 0.2 |
| 0.5 | 2 | 0.2 |
| 15.5 | 40 | 0.2 |
| 18 | 40 | 0.2 |
| 18.5 | 90 | 0.2 |
| 21 | 90 | 0.2 |
| 21.5 | 2 | 0.2 |
| 28 | 2 | 0.2 |

Column Oven

| | |
|---|---|
| Oven Set Point: | 36 degrees Celsius |

Acquisition Window

| | |
|---|---|
| Start Time: | 0 min. |
| End Time: | 28 min. |

-continued

| Other Options | |
|---|---|
| Wash Type: | Normal wash |
| Needle Dip Time: | 2 sec |
| AutoSampler Rinse Volume: | 500 uL |
| AutoSampler Rinse Speed: | 35 uL/sec |
| AutoSampler Rinse Mode: | 2 |
| Sampling Speed: | 5 uL/sec |
| Error Recovery Policy: | Continue running other streams and abort samples on the failed stream. |

| Valco Valve Diverter | | |
|---|---|---|
| Total | Time (min) | Position |
| 1 | 0.1 | A |

Quantitation Information:

| Sample Type: | Unknown |
|---|---|
| Dilution Factor: | 1.000000 |
| | Custom Data: |
| | Quantitation Table: |
| | Period 1: |
| Scans in Period: | 1199 |
| Relative Start Time: | 0.00 msec |
| Experiments in Period: | 1 |

Period 1 Experiment 1:

| Scan Type: | MRM (MRM) |
|---|---|
| Scheduled MRM: | No |
| Polarity: | Positive |
| Scan Mode: | N/A |
| Ion Source: | Turbo Spray |
| Resolution Q1: | Unit |
| Resolution Q3: | Unit |
| Intensity Thres.: | 0.00 cps |
| Settling Time: | 0.0000 msec |
| MR Pause: | 5.0070 msec |
| MCA: | No |
| Step Size: | 0.00 Da |

| Q1 Mass (Da) | Q3 Mass (Da) | Dwell(msec) | Param | Start | Stop | ID |
|---|---|---|---|---|---|---|
| 477.100 | 391.700 | 5.00 | DP | 50.00 | 50.00 | CAH1-1_y6_+2 _h |
| | | | CE | 23.00 | 23.00 | |
| | | | CXP | 54.00 | 54.00 | |
| 477.100 | 468.000 | 5.00 | DP | 50.00 | 50.00 | CAH1-1_ MH-H2_+2 _h |
| | | | CE | 19.00 | 19.00 | |
| | | | CXP | 12.00 | 12.00 | |
| 477.100 | 782.400 | 5.00 | DP | 50.00 | 50.00 | CAH1-1_y6, b7-NH3 _h |
| | | | CE | 21.00 | 21.00 | |
| | | | CXP | 22.00 | 22.00 | |
| 477.100 | 420.200 | 5.00 | DP | 50.00 | 50.00 | CAH1-1_y7_+2 _h |
| | | | CE | 21.00 | 21.00 | |
| | | | CXP | 12.00 | 12.00 | |
| 477.100 | 428.100 | 5.00 | DP | 50.00 | 50.00 | CAH1-1_y3 _h |
| | | | CE | 25.00 | 25.00 | |
| | | | CXP | 34.00 | 34.00 | |
| 498.200 | 441.100 | 5.00 | DP | 66.00 | 66.00 | CAH1-2_y7_+2_h |
| | | | CE | 21.00 | 21.00 | |
| | | | CXP | 12.00 | 12.00 | |
| 498.200 | 637.200 | 5.00 | DP | 66.00 | 66.00 | CAH1-2_y5 _h |
| | | | CE | 25.00 | 25.00 | |
| | | | CXP | 16.00 | 16.00 | |
| 498.200 | 784.000 | 5.00 | DP | 66.00 | 66.00 | CAH1-2_y6 _h |
| | | | CE | 29.00 | 29.00 | |
| | | | CXP | 22.00 | 22.00 | |
| 498.200 | 435.100 | 5.00 | DP | 66.00 | 66.00 | CAH1-2_ y3, SDSY (SEQ ID NO: 1270)-H2O _h |
| | | | CE | 35.00 | 35.00 | |
| | | | CXP | 12.00 | 12.00 | |
| 498.200 | 331.100 | 5.00 | DP | 66.00 | 66.00 | CAH1-2_y2-NH3, a4 _h |
| | | | CE | 21.00 | 21.00 | |
| | | | CXP | 26.00 | 26.00 | |

-continued

| | | | | | | |
|---|---|---|---|---|---|---|
| 517.700 | 784.100 | 5.00 | DP | 106.00 | 106.00 | CAH1-3_y8_h |
| | | | CE | 21.00 | 21.00 | |
| | | | CXP | 20.00 | 20.00 | |
| 517.700 | 383.700 | 5.00 | DP | 106.00 | 106.00 | CAH1-3_y8-H2O_+2_h |
| | | | CE | 23.00 | 23.00 | |
| | | | CXP | 12.00 | 12.00 | |
| 517.700 | 584.300 | 5.00 | DP | 106.00 | 106.00 | CAH1-3_y6_h |
| | | | CE | 25.00 | 25.00 | |
| | | | CXP | 16.00 | 16.00 | |
| 517.700 | 871.300 | 5.00 | DP | 106.00 | 106.00 | CAH1-3_y9_h |
| | | | CE | 25.00 | 25.00 | |
| | | | CXP | 24.00 | 24.00 | |
| 517.700 | 320.000 | 5.00 | DP | 106.00 | 106.00 | CAH1-3_ b3-H2O _h |
| | | | CE | 27.00 | 27.00 | |
| | | | CXP | 26.00 | 26.00 | |
| 489.800 | 766.300 | 5.00 | DP | 71.00 | 71.00 | CAH1-4_y7 _h |
| | | | CE | 21.00 | 21.00 | |
| | | | CXP | 20.00 | 20.00 | |
| 489.800 | 499.100 | 5.00 | DP | 71.00 | 71.00 | CAH1-4_ DALQA (SEQ ID NO: 1271) _h |
| | | | CE | 31.00 | 31.00 | |
| | | | CXP | 14.00 | 14.00 | |
| 489.800 | 879.400 | 5.00 | DP | 71.00 | 71.00 | CAH1-4_y8 _h |
| | | | CE | 21.00 | 21.00 | |
| | | | CXP | 24.00 | 24.00 | |
| 489.800 | 651.300 | 5.00 | DP | 71.00 | 71.00 | CAH1-4_y6 _h |
| | | | CE | 23.00 | 23.00 | |
| | | | CXP | 18.00 | 18.00 | |
| 489.800 | 328.100 | 5.00 | DP | 71.00 | 71.00 | CAH1-4_ b3 _h |
| | | | CE | 21.00 | 21.00 | |
| | | | CXP | 28.00 | 28.00 | |
| 632.700 | 716.300 | 5.00 | DP | 41.00 | 41.00 | S100A7-1_y6 _h |
| | | | CE | 27.00 | 27.00 | |
| | | | CXP | 20.00 | 20.00 | |
| 632.700 | 829.200 | 5.00 | DP | 41.00 | 41.00 | S100A7-1_ y7 _h |
| | | | CE | 27.00 | 27.00 | |
| | | | CXP | 22.00 | 22.00 | |
| 632.700 | 623.800 | 5.00 | DP | 41.00 | 41.00 | S100A7-1_ MH-H2_ +2_h |
| | | | CE | 23.00 | 23.00 | |
| | | | CXP | 18.00 | 18.00 | |
| 632.700 | 431.100 | 5.00 | DP | 41.00 | 41.00 | S100A7-1_ y3 _h |
| | | | CE | 39.00 | 39.00 | |
| | | | CXP | 12.00 | 12.00 | |
| 632.700 | 436.200 | 5.00 | DP | 41.00 | 41.00 | S100A7-1_ b4 _h |
| | | | CE | 23.00 | 23.00 | |
| | | | CXP | 12.00 | 12.00 | |
| 731.600 | 982.400 | 5.00 | DP | 81.00 | 81.00 | S100A7-2_ y17_+2 _h |
| | | | CE | 25.00 | 25.00 | |
| | | | CXP | 24.00 | 24.00 | |
| 731.600 | 1027.300 | 5.00 | DP | 81.00 | 81.00 | S100A7-2_ y9_h |
| | | | CE | 33.00 | 33.00 | |
| | | | CXP | 28.00 | 28.00 | |
| 731.600 | 908.900 | 5.00 | DP | 81.00 | 81.00 | S100A7-2_ y16_+2 _h |
| | | | CE | 25.00 | 25.00 | |
| | | | CXP | 24.00 | 24.00 | |
| 731.600 | 1040.100 | 5.00 | DP | 81.00 | 81.00 | S100A7-2_ y18_+2 _h |
| | | | CE | 25.00 | 25.00 | |
| | | | CXP | 26.00 | 26.00 | |
| 731.600 | 742.200 | 5.00 | DP | 81.00 | 81.00 | S100A7-2_ y6 or EFLSLLG (SEQ ID NO: 1272)-H2O _h |
| | | | CE | 35.00 | 35.00 | |
| | | | CXP | 20.00 | 20.00 | |
| 640.900 | 782.300 | 5.00 | DP | 101.00 | 101.00 | S100A8-1_ y6 _h |
| | | | CE | 31.00 | 31.00 | |
| | | | CXP | 20.00 | 20.00 | |
| 640.900 | 548.700 | 5.00 | DP | 101.00 | 101.00 | S100A8-1_ y9_+2 _h |
| | | | CE | 29.00 | 29.00 | |
| | | | CXP | 14.00 | 14.00 | |
| 640.900 | 669.200 | 5.00 | DP | 101.00 | 101.00 | S100A8-1_ y5 _h |
| | | | CE | 33.00 | 33.00 | |
| | | | CXP | 18.00 | 18.00 | |
| 640.900 | 368.100 | 5.00 | DP | 101.00 | 101.00 | S100A8-1_ b4-H2O _h |
| | | | CE | 33.00 | 33.00 | |
| | | | CXP | 32.00 | 32.00 | |
| 640.900 | 982.400 | 5.00 | DP | 101.00 | 101.00 | S100A8-1_ y8 _h |
| | | | CE | 31.00 | 31.00 | |
| | | | CXP | 26.00 | 26.00 | |

-continued

| | | | | | | |
|---|---|---|---|---|---|---|
| 487.200 | 518.200 | 5.00 | DP | 86.00 | 86.00 | S100A8-2_ y4 _h |
| | | | CE | 29.00 | 29.00 | |
| | | | CXP | 14.00 | 14.00 | |
| 487.200 | 655.200 | 5.00 | DP | 86.00 | 86.00 | S100A8-2_ y5 _h |
| | | | CE | 27.00 | 27.00 | |
| | | | CXP | 18.00 | 18.00 | |
| 487.200 | 328.200 | 5.00 | DP | 86.00 | 86.00 | S100A8-2_ y5_ +2, FHA-28 _h |
| | | | CE | 27.00 | 27.00 | |
| | | | CXP | 10.00 | 10.00 | |
| 487.200 | 447.200 | 5.00 | DP | 86.00 | 86.00 | S100A8-2_ y3 _h |
| | | | CE | 31.00 | 31.00 | |
| | | | CXP | 12.00 | 12.00 | |
| 487.200 | 401.700 | 5.00 | DP | 86.00 | 86.00 | S100A8-2_ y6_+2 _h |
| | | | CE | 25.00 | 25.00 | |
| | | | CXP | 12.00 | 12.00 | |
| 485.700 | 656.100 | 5.00 | DP | 61.00 | 61.00 | CATA-1_ y5 _h |
| | | | CE | 21.00 | 21.00 | |
| | | | CXP | 18.00 | 18.00 | |
| 485.700 | 543.100 | 5.00 | DP | 61.00 | 61.00 | CATA-1_ y4 _h |
| | | | CE | 21.00 | 21.00 | |
| | | | CXP | 16.00 | 16.00 | |
| 485.700 | 315.100 | 5.00 | DP | 61.00 | 61.00 | CATA-1_ b3 _h |
| | | | CE | 21.00 | 21.00 | |
| | | | CXP | 24.00 | 24.00 | |
| 485.700 | 392.700 | 5.00 | DP | 61.00 | 61.00 | CATA-1_ y6_+2 _h |
| | | | CE | 19.00 | 19.00 | |
| | | | CXP | 8.00 | 8.00 | |
| 485.700 | 784.300 | 5.00 | DP | 61.00 | 61.00 | CATA-1_ y6 _h |
| | | | CE | 21.00 | 21.00 | |
| | | | CXP | 20.00 | 20.00 | |
| 529.300 | 829.200 | 5.00 | DP | 56.00 | 56.00 | CATA-2_ y8, b8-NH3 _h |
| | | | CE | 23.00 | 23.00 | |
| | | | CXP | 22.00 | 22.00 | |
| 529.300 | 682.300 | 5.00 | DP | 56.00 | 56.00 | CATA-2_ y7 _h |
| | | | CE | 25.00 | 25.00 | |
| | | | CXP | 18.00 | 18.00 | |
| 529.300 | 384.200 | 5.00 | DP | 56.00 | 56.00 | CATA-2_ y4 _h |
| | | | CE | 33.00 | 33.00 | |
| | | | CXP | 32.00 | 32.00 | |
| 529.300 | 415.200 | 5.00 | DP | 56.00 | 56.00 | CATA-2_ y8_+2 _h |
| | | | CE | 21.00 | 21.00 | |
| | | | CXP | 10.00 | 10.00 | |
| 529.300 | 568.200 | 5.00 | DP | 56.00 | 56.00 | CATA-2_ y6 _h |
| | | | CE | 27.00 | 27.00 | |
| | | | CXP | 16.00 | 16.00 | |
| 513.100 | 476.300 | 5.00 | DP | 36.00 | 36.00 | CATA-3_ y8_+2 _h |
| | | | CE | 23.00 | 23.00 | |
| | | | CXP | 14.00 | 14.00 | |
| 513.100 | 549.800 | 5.00 | DP | 36.00 | 36.00 | CATA-3_ y9_+2 _h |
| | | | CE | 21.00 | 21.00 | |
| | | | CXP | 8.00 | 8.00 | |
| 513.100 | 606.200 | 5.00 | DP | 36.00 | 36.00 | CATA-3_ y10_+2 _h |
| | | | CE | 19.00 | 19.00 | |
| | | | CXP | 16.00 | 16.00 | |
| 513.100 | 326.200 | 5.00 | DP | 36.00 | 36.00 | CATA-3_ b3 _h |
| | | | CE | 21.00 | 21.00 | |
| | | | CXP | 28.00 | 28.00 | |
| 513.100 | 951.300 | 5.00 | DP | 36.00 | 36.00 | CATA-3_ y8 _h |
| | | | CE | 21.00 | 21.00 | |
| | | | CXP | 26.00 | 26.00 | |
| 565.200 | 635.200 | 5.00 | DP | 81.00 | 81.00 | CATA-4_ y5 _h |
| | | | CE | 27.00 | 27.00 | |
| | | | CXP | 16.00 | 16.00 | |
| 565.200 | 869.300 | 5.00 | DP | 81.00 | 81.00 | CATA-4_ y7 _h |
| | | | CE | 27.00 | 27.00 | |
| | | | CXP | 24.00 | 24.00 | |
| 565.200 | 332.200 | 5.00 | DP | 81.00 | 81.00 | CATA-4_ b3 or AYP _h |
| | | | CE | 27.00 | 27.00 | |
| | | | CXP | 10.00 | 10.00 | |
| 565.200 | 423.100 | 5.00 | DP | 81.00 | 81.00 | CATA-4_ y3 or PDTH (SEQ ID NO: 1273)-28 _h |
| | | | CE | 39.00 | 39.00 | |
| | | | CXP | 34.00 | 34.00 | |
| 565.200 | 798.200 | 5.00 | DP | 81.00 | 81.00 | CATA-4_ y6 _h |
| | | | CE | 27.00 | 27.00 | |
| | | | CXP | 22.00 | 22.00 | |

-continued

| | | | | | | |
|---|---|---|---|---|---|---|
| 475.300 | 454.200 | 5.00 | DP | 66.00 | 66.00 | APOA2-1_ b4-H2O _h |
| | | | CE | 19.00 | 19.00 | |
| | | | CXP | 12.00 | 12.00 | |
| 475.300 | 579.200 | 5.00 | DP | 66.00 | 66.00 | APOA2-1_ y5 _h |
| | | | CE | 21.00 | 21.00 | |
| | | | CXP | 16.00 | 16.00 | |
| 475.300 | 692.400 | 5.00 | DP | 66.00 | 66.00 | APOA2-1_ y6 _h |
| | | | CE | 21.00 | 21.00 | |
| | | | CXP | 20.00 | 20.00 | |
| 475.300 | 466.300 | 5.00 | DP | 66.00 | 66.00 | APOA2-1_ MH-H2O_+2 _h |
| | | | CE | 15.00 | 15.00 | |
| | | | CXP | 12.00 | 12.00 | |
| 475.300 | 353.000 | 5.00 | DP | 66.00 | 66.00 | APOA2-1_ b3-H2O _h |
| | | | CE | 21.00 | 21.00 | |
| | | | CXP | 32.00 | 32.00 | |
| 490.800 | 447.200 | 5.00 | DP | 71.00 | 71.00 | APOA2-2_ y8_+2 _h |
| | | | CE | 25.00 | 25.00 | |
| | | | CXP | 12.00 | 12.00 | |
| 490.800 | 796.300 | 5.00 | DP | 71.00 | 71.00 | APOA2-2_ y7 _h |
| | | | CE | 25.00 | 25.00 | |
| | | | CXP | 22.00 | 22.00 | |
| 490.800 | 667.300 | 5.00 | DP | 71.00 | 71.00 | APOA2-2_ y6 _h |
| | | | CE | 27.00 | 27.00 | |
| | | | CXP | 18.00 | 18.00 | |
| 490.800 | 314.100 | 5.00 | DP | 71.00 | 71.00 | APOA2-2_ b3 _h |
| | | | CE | 27.00 | 27.00 | |
| | | | CXP | 26.00 | 26.00 | |
| 490.800 | 554.200 | 5.00 | DP | 71.00 | 71.00 | APOA2-2_ y5, ELQAE (SEQ ID NO: 1274)-NH3 _h |
| | | | CE | 25.00 | 25.00 | |
| | | | CXP | 16.00 | 16.00 | |
| 471.800 | 398.100 | 5.00 | DP | 71.00 | 71.00 | CD38-1_y7_+2_h |
| | | | CE | 25.00 | 25.00 | |
| | | | CXP | 32.00 | 32.00 | |
| 471.800 | 698.300 | 5.00 | DP | 71.00 | 71.00 | CD38-1_y6_h |
| | | | CE | 27.00 | 27.00 | |
| | | | CXP | 20.00 | 20.00 | |
| 471.800 | 569.200 | 5.00 | DP | 71.00 | 71.00 | CD38-1_y5_h |
| | | | CE | 29.00 | 29.00 | |
| | | | CXP | 16.00 | 16.00 | |
| 471.800 | 795.300 | 5.00 | DP | 71.00 | 71.00 | CD38-1_y7_h |
| | | | CE | 25.00 | 25.00 | |
| | | | CXP | 22.00 | 22.00 | |
| 471.800 | 389.200 | 5.00 | DP | 71.00 | 71.00 | CD38-1_y7-H2O_+2_h |
| | | | CE | 27.00 | 27.00 | |
| | | | CXP | 12.00 | 12.00 | |
| 600.300 | 671.200 | 5.00 | DP | 56.00 | 56.00 | CD38-2_y6_h |
| | | | CE | 31.00 | 31.00 | |
| | | | CXP | 18.00 | 18.00 | |
| 600.300 | 898.300 | 5.00 | DP | 56.00 | 56.00 | CD38-2_y8_h |
| | | | CE | 29.00 | 29.00 | |
| | | | CXP | 24.00 | 24.00 | |
| 600.300 | 591.300 | 5.00 | DP | 56.00 | 56.00 | CD38-2_MH-H2O_+2_h |
| | | | CE | 23.00 | 23.00 | |
| | | | CXP | 6.00 | 6.00 | |
| 600.300 | 284.000 | 5.00 | DP | 56.00 | 56.00 | CD38-2_ b3-H2O, AQT-NH3_h |
| | | | CE | 29.00 | 29.00 | |
| | | | CXP | 26.00 | 26.00 | |
| 600.300 | 784.200 | 5.00 | DP | 56.00 | 56.00 | CD38-2_y7, a8-NH3_h |
| | | | CE | 31.00 | 31.00 | |
| | | | CXP | 22.00 | 22.00 | |
| 648.300 | 639.300 | 5.00 | DP | 81.00 | 81.00 | CD38-3_MH-H2O_+2, LFQYS (SEQ ID NO: 1275)_h |
| | | | CE | 23.00 | 23.00 | |
| | | | CXP | 18.00 | 18.00 | |
| 648.300 | 737.200 | 5.00 | DP | 81.00 | 81.00 | CD38-3_y6, TTLFQY (SEQ ID NO: 1276)-NH3_h |
| | | | CE | 29.00 | 29.00 | |
| | | | CXP | 20.00 | 20.00 | |
| 648.300 | 951.300 | 5.00 | DP | 81.00 | 81.00 | CD38-3_y8, ATTLFQYSG (SEQ ID NO: 1277)-H2O _h |
| | | | CE | 29.00 | 29.00 | |
| | | | CXP | 26.00 | 26.00 | |
| 648.300 | 1123.400 | 5.00 | DP | 81.00 | 81.00 | CD38-3_y10, b11-H2O_h |
| | | | CE | 27.00 | 27.00 | |
| | | | CXP | 30.00 | 30.00 | |

-continued

| | | | | | | |
|---|---|---|---|---|---|---|
| 648.300 | 850.200 | 5.00 | DP | 81.00 | 81.00 | CD38-3_y7_h |
| | | | CE | 29.00 | 29.00 | |
| | | | CXP | 22.00 | 22.00 | |
| 600.400 | 680.100 | 5.00 | DP | 41.00 | 41.00 | NGAL2-1_ b6 _h |
| | | | CE | 25.00 | 25.00 | |
| | | | CXP | 52.00 | 52.00 | |
| 600.400 | 844.300 | 5.00 | DP | 41.00 | 41.00 | NGAL2-1_ y7, c7 _h |
| | | | CE | 23.00 | 23.00 | |
| | | | CXP | 24.00 | 24.00 | |
| 600.400 | 487.100 | 5.00 | DP | 41.00 | 41.00 | NGAL2-1_ y4, FQDN (SEQ ID NO: 1278)-H2O, NFQD (SEQ ID NO: 1279)-H2O, DNQF (SEQ ID NO: 1280)-H2O_h |
| | | | CE | 23.00 | 23.00 | |
| | | | CXP | 42.00 | 42.00 | |
| 600.400 | 323.100 | 5.00 | DP | 41.00 | 41.00 | NGAL2-1_ y3-NH3 _h |
| | | | CE | 39.00 | 39.00 | |
| | | | CXP | 32.00 | 32.00 | |
| 600.400 | 827.300 | 5.00 | DP | 41.00 | 41.00 | NGAL2-1_ b7, y7-NH3 _h |
| | | | CE | 23.00 | 23.00 | |
| | | | CXP | 22.00 | 22.00 | |
| 598.300 | 732.300 | 5.00 | DP | 56.00 | 56.00 | NGAL2-2_ y6 _h |
| | | | CE | 27.00 | 27.00 | |
| | | | CXP | 20.00 | 20.00 | |
| 598.300 | 945.400 | 5.00 | DP | 56.00 | 56.00 | NGAL2-2_ y8 _h |
| | | | CE | 25.00 | 25.00 | |
| | | | CXP | 26.00 | 26.00 | |
| 598.300 | 365.100 | 5.00 | DP | 56.00 | 56.00 | NGAL2-2_ b3 _h |
| | | | CE | 27.00 | 27.00 | |
| | | | CXP | 34.00 | 34.00 | |
| 598.300 | 464.100 | 5.00 | DP | 56.00 | 56.00 | NGAL2-2_ b4, y8-H2O_+2 _h |
| | | | CE | 21.00 | 21.00 | |
| | | | CXP | 14.00 | 14.00 | |
| 598.300 | 631.200 | 5.00 | DP | 56.00 | 56.00 | NGAL2-2_ y5 _h |
| | | | CE | 27.00 | 27.00 | |
| | | | CXP | 18.00 | 18.00 | |
| 633.400 | 508.300 | 5.00 | DP | 71.00 | 71.00 | NGAL2-3_ y9_+2 _h |
| | | | CE | 25.00 | 25.00 | |
| | | | CXP | 14.00 | 14.00 | |
| 633.400 | 748.200 | 5.00 | DP | 71.00 | 71.00 | NGAL2-3_ y6 _h |
| | | | CE | 35.00 | 35.00 | |
| | | | CXP | 20.00 | 20.00 | |
| 633.400 | 1015.400 | 5.00 | DP | 71.00 | 71.00 | NGAL2-3_ y9 _h |
| | | | CE | 27.00 | 27.00 | |
| | | | CXP | 28.00 | 28.00 | |
| 633.400 | 918.400 | 5.00 | DP | 71.00 | 71.00 | NGAL2-3_ y8 _h |
| | | | CE | 35.00 | 35.00 | |
| | | | CXP | 26.00 | 26.00 | |
| 633.400 | 647.200 | 5.00 | DP | 71.00 | 71.00 | NGAL2-3_ y5 _h |
| | | | CE | 37.00 | 37.00 | |
| | | | CXP | 18.00 | 18.00 | |
| 678.400 | 827.400 | 5.00 | DP | 71.00 | 71.00 | MMP9-1_ y7 or LVLFPGDL (SEQ ID NO: 1281)-28 _h |
| | | | CE | 35.00 | 35.00 | |
| | | | CXP | 22.00 | 22.00 | |
| 678.400 | 669.100 | 5.00 | DP | 71.00 | 71.00 | MMP9-1_ MH-H2O_+2 _h |
| | | | CE | 27.00 | 27.00 | |
| | | | CXP | 18.00 | 18.00 | |
| 678.400 | 567.300 | 5.00 | DP | 71.00 | 71.00 | MMP9-1_ y5 _h |
| | | | CE | 29.00 | 29.00 | |
| | | | CXP | 16.00 | 16.00 | |
| 678.400 | 714.100 | 5.00 | DP | 71.00 | 71.00 | MMP9-1_ y6, VLFPGDL (SEQ ID NO: 1282)-28, LVLFPGD (SEQ ID NO: 1283)-28 _h |
| | | | CE | 29.00 | 29.00 | |
| | | | CXP | 18.00 | 18.00 | |
| 678.400 | 926.400 | 5.00 | DP | 71.00 | 71.00 | MMP9-1_ y8, b9-NH3 _h |
| | | | CE | 33.00 | 33.00 | |
| | | | CXP | 24.00 | 24.00 | |
| 581.000 | 480.800 | 5.00 | DP | 76.00 | 76.00 | MMP9-2_ y9_+2 _h |
| | | | CE | 25.00 | 25.00 | |
| | | | CXP | 14.00 | 14.00 | |
| 581.000 | 960.500 | 5.00 | DP | 76.00 | 76.00 | MMP9-2_ y9 _h |
| | | | CE | 25.00 | 25.00 | |
| | | | CXP | 26.00 | 26.00 | |
| 581.000 | 452.300 | 5.00 | DP | 76.00 | 76.00 | MMP9-2_ y8_+2, GPALL (SEQ ID NO: 1285), LGPAL (SEQ ID NO: 1284) _h |

| | | | | | |
|---|---|---|---|---|---|
| | | | CE | 27.00 | 27.00 | |
| | | | CXP | 12.00 | 12.00 | |
| 581.000 | 622.300 | 5.00 | DP | 76.00 | 76.00 | MMP9-2_ y5 _h |
| | | | CE | 31.00 | 31.00 | |
| | | | CXP | 18.00 | 18.00 | |
| 581.000 | 735.400 | 5.00 | DP | 76.00 | 76.00 | MMP9-2_ y6 _h |
| | | | CE | 31.00 | 31.00 | |
| | | | CXP | 20.00 | 20.00 | |
| 597.800 | 588.600 | 5.00 | DP | 71.00 | 71.00 | MMP9-3_ MH-H2O_+2 _h |
| | | | CE | 25.00 | 25.00 | |
| | | | CXP | 16.00 | 16.00 | |
| 597.800 | 953.300 | 5.00 | DP | 71.00 | 71.00 | MMP9-3_ y7 _h |
| | | | CE | 31.00 | 31.00 | |
| | | | CXP | 26.00 | 26.00 | |
| 597.800 | 753.300 | 5.00 | DP | 71.00 | 71.00 | MMP9-3_ y5 _h |
| | | | CE | 31.00 | 31.00 | |
| | | | CXP | 22.00 | 22.00 | |
| 597.800 | 624.200 | 5.00 | DP | 71.00 | 71.00 | MMP9-3_ y4 _h |
| | | | CE | 33.00 | 33.00 | |
| | | | CXP | 54.00 | 54.00 | |
| 597.800 | 330.100 | 5.00 | DP | 71.00 | 71.00 | MMP9-3_ AEE, c3 _h |
| | | | CE | 45.00 | 45.00 | |
| | | | CXP | 30.00 | 30.00 | |
| 517.300 | 785.300 | 5.00 | DP | 76.00 | 76.00 | MMP9-4_ y7 _h |
| | | | CE | 25.00 | 25.00 | |
| | | | CXP | 22.00 | 22.00 | |
| 517.300 | 656.300 | 5.00 | DP | 76.00 | 76.00 | MMP9-4_ y6 _h |
| | | | CE | 27.00 | 27.00 | |
| | | | CXP | 18.00 | 18.00 | |
| 517.300 | 599.300 | 5.00 | DP | 76.00 | 76.00 | MMP9-4_ y5 _h |
| | | | CE | 29.00 | 29.00 | |
| | | | CXP | 18.00 | 18.00 | |
| 517.300 | 508.300 | 5.00 | DP | 76.00 | 76.00 | MMP9-4_ MH-H2O_+2 _h |
| | | | CE | 23.00 | 23.00 | |
| | | | CXP | 14.00 | 14.00 | |
| 517.300 | 502.300 | 5.00 | DP | 76.00 | 76.00 | MMP9-4_ y4 _h |
| | | | CE | 35.00 | 35.00 | |
| | | | CXP | 14.00 | 14.00 | |
| 726.000 | 825.300 | 5.00 | DP | 101.00 | 101.00 | MMP9-5_ y8, b9_h |
| | | | CE | 37.00 | 37.00 | |
| | | | CXP | 22.00 | 22.00 | |
| 726.000 | 527.300 | 5.00 | DP | 101.00 | 101.00 | MMP9-5_y5, b6, LGADVA (SEQ ID NO: 1286) _h |
| | | | CE | 35.00 | 35.00 | |
| | | | CXP | 14.00 | 14.00 | |
| 726.000 | 754.300 | 5.00 | DP | 101.00 | 101.00 | MMP9-5_ y7, LGADVAQV (SEQ ID NO: 1287) _h |
| | | | CE | 37.00 | 37.00 | |
| | | | CXP | 20.00 | 20.00 | |
| 726.000 | 626.300 | 5.00 | DP | 101.00 | 101.00 | MMP9-5_y6, b7 _h |
| | | | CE | 33.00 | 33.00 | |
| | | | CXP | 16.00 | 16.00 | |
| 726.000 | 1039.500 | 5.00 | DP | 101.00 | 101.00 | MMP9-5_ y10 _h |
| | | | CE | 37.00 | 37.00 | |
| | | | CXP | 28.00 | 28.00 | |
| 555.200 | 441.200 | 5.00 | DP | 51.00 | 51.00 | BGAL-1_ y7_+2, PNAW (SEQ ID NO: 1288)-28 _h |
| | | | CE | 23.00 | 23.00 | |
| | | | CXP | 12.00 | 12.00 | |
| 555.200 | 881.300 | 5.00 | DP | 51.00 | 51.00 | BGAL-1_ y7 _h |
| | | | CE | 25.00 | 25.00 | |
| | | | CXP | 24.00 | 24.00 | |
| 555.200 | 670.200 | 5.00 | DP | 51.00 | 51.00 | BGAL-1_ y5 _h |
| | | | CE | 31.00 | 31.00 | |
| | | | CXP | 18.00 | 18.00 | |
| 555.200 | 784.300 | 5.00 | DP | 51.00 | 51.00 | BGAL-1_ y6, DPNAWVE (SEQ ID NO: 1289)-28 _h |
| | | | CE | 31.00 | 31.00 | |
| | | | CXP | 22.00 | 22.00 | |
| 555.200 | 599.200 | 5.00 | DP | 51.00 | 51.00 | BGAL-1_ y4 _h |
| | | | CE | 33.00 | 33.00 | |
| | | | CXP | 16.00 | 16.00 | |
| 547.200 | 646.200 | 5.00 | DP | 51.00 | 51.00 | BGAL-2_ y5 _h |
| | | | CE | 27.00 | 27.00 | |
| | | | CXP | 18.00 | 18.00 | |

-continued

| | | | | | | |
|---|---|---|---|---|---|---|
| 547.200 | 499.200 | 5.00 | DP | 51.00 | 51.00 | BGAL-2_ y4 _h |
| | | | CE | 25.00 | 25.00 | |
| | | | CXP | 14.00 | 14.00 | |
| 547.200 | 461.200 | 5.00 | DP | 51.00 | 51.00 | BGAL-2_ y7_+2 _h |
| | | | CE | 21.00 | 21.00 | |
| | | | CXP | 12.00 | 12.00 | |
| 547.200 | 774.300 | 5.00 | DP | 51.00 | 51.00 | BGAL-2_ y6 _h |
| | | | CE | 25.00 | 25.00 | |
| | | | CXP | 20.00 | 20.00 | |
| 547.200 | 538.200 | 5.00 | DP | 51.00 | 51.00 | BGAL-2_ MH-H2O_+2 _h |
| | | | CE | 17.00 | 17.00 | |
| | | | CXP | 14.00 | 14.00 | |
| 539.200 | 792.300 | 5.00 | DP | 76.00 | 76.00 | BGAL-3_ y7 _h |
| | | | CE | 25.00 | 25.00 | |
| | | | CXP | 22.00 | 22.00 | |
| 539.200 | 286.100 | 5.00 | DP | 76.00 | 76.00 | BGAL-3_ b2 _h |
| | | | CE | 23.00 | 23.00 | |
| | | | CXP | 24.00 | 24.00 | |
| 539.200 | 272.000 | 5.00 | DP | 76.00 | 76.00 | BGAL-3_ y2 _h |
| | | | CE | 37.00 | 37.00 | |
| | | | CXP | 24.00 | 24.00 | |
| 539.200 | 530.700 | 5.00 | DP | 76.00 | 76.00 | BGAL-3_ MH-NH3_ +2 _h |
| | | | CE | 23.00 | 23.00 | |
| | | | CXP | 14.00 | 14.00 | |
| 539.200 | 572.200 | 5.00 | DP | 76.00 | 76.00 | BGAL-3_ y5 _h |
| | | | CE | 27.00 | 27.00 | |
| | | | CXP | 16.00 | 16.00 | |

| Parameter Table(Period 1 Experiment 1) | |
|---|---|
| CUR: | 30.00 |
| CAD: | Medium |
| IS: | 5000.00 |
| TEM: | 500.00 |
| GS1: | 40.00 |
| GS2: | 60.00 |
| EP | 10.00 |

Resolution tables

| Mass (Da) | Offset Value |
|---|---|
| Quad 1 Positive Unit Scan Speed = 10 Da/s Last Modification Date Time: Oct. 3, 2011 11:56:39 IE1 1.000 | |
| 59.050 | −0.250 |
| 175.133 | −0.630 |
| 500.380 | −1.695 |
| 616.464 | −2.045 |
| 906.673 | −3.040 |
| Quad 3 Positive Unit Scan Speed = 10 Da/s Last Modification Date Time: Sep. 30, 2011 11:36:11 IE3 0.900 | |
| 59.050 | −0.170 |
| 175.133 | −0.450 |
| 500.380 | −1.280 |
| 616.464 | −1.585 |
| 906.673 | −2.320 |

Calibration tables

| Mass (Da) | Dac Value |
|---|---|
| Quad 1 Positive Unit Resolution Scan Speed = 10 Da/s Last Modification Date Time: Sep. 30, 2011 11:18:56 | |
| 59.050 | 10826 |
| 175.133 | 32398 |
| 500.380 | 92858 |
| 616.464 | 114436 |
| 906.673 | 168380 |
| Quad 3 Positive Unit Resolution Scan Speed = 10 Da/s Last Modification Date Time: Sep.r 30, 2011 11:36:51 | |
| 59.050 | 10797 |
| 175.133 | 32322 |
| 500.380 | 92649 |

|  |  |
|---|---|
| 616.464 | 114180 |
| 906.673 | 168004 |

| Instrument Parameters: | |
|---|---|
| Detector Parameters (Positive): | CEM 2300.0 |
| Keyed Text: | File was created with the software version: Analyst 1.5.1 |

EXAMPLE 4: Detailed MRM method 3 for measuring 10 markers (Beta-Ala-His dipeptidase (CNDP1), Cysteine and glycine-rich protein 1 (CSRP1), Exostosin-like 2 (EXTL2), S100A1, S100A12, S100A4, S100A6, SH3 domain-binding glutamic acid rich-like protein (SH3 or SH3L), Thioredoxin (THIO), Isoform 2 of Transmembrane protease serine 4 (TMPR4, TMPS4 or TMPRSS4) and workflow control Beta gal with three peptides. It is understood that various embodiments of the present invention include performing the MRM described in this Example 4 including analyzing one or more of the peptides described herein, recited transitions, as well as using the parameters described herein. One of ordinary skill in the art can perform the method of Example 4 without undue experimentation.

| File Information for Sample 3 (IS003) of 20120413-4.wiff | |
|---|---|
| File Name: | 20120413-4.wiff |
| File Path: | C:\Analyst Data\Projects\UnipathII\Data\ |
| Original Name: | 20120413-4.wiff |
| Software Version: | Analyst 1.5.2 |
| Log Information from Devices at Start of acquisition: | |
| Software Application MPX Driver | 0 |
| Time from start = 0.0000 min MPX Driver User = JVELABFFW\ Computer = JVELABFFW | |
| Sample was Scheduled By user 'JVELABFFW\Administrator' through MPX Walk-Up. | |
| Time from start = 0.0000 min MPX Driver User = JVELABFFW\ Computer = JVELABFFW | |
| System Info. | |
| Stream Injected | 2 |
| Oven Temp. | 36 |
| Autosampler Vendor | Shimadzu_Shimadzu |
| Loading Pump Type | Single Solvent Selection |
| Online SPE | No |
| Stream 1 Info. | |
| Flow Rate | 0.2 mL/min |
| Pump A Pressure | 1205.55 (psi) |
| Pump B Pressure | 1218.46 (psi) |
| Cooler Temp. | 15.01 degrees Celsius |
| Rack Changer Temp. | −1 degrees Celsius |
| Stream 2 Info. | |
| Flow Rate | 0.2 mL/min |
| Pump A Pressure | 1373.80 (psi) |
| Pump B Pressure | 1336.81 (psi) |
| Cooler Temp. | 15.03 degrees Celsius |
| Rack Changer Temp. | −1 degrees Celsius |
| Time from start = 0.0000 min Mass Spectrometer QTRAP 5500 0 | |
| Config Table Version | 01 |
| Firmware Version | — —PIL0103 PIB0101 |
| Component Name | Linear Ion Trap Quadrupole LC/MS/MS Mass Spectrometer |
| Component ID | QTRAP 5500 |
| Manufacturer | AB Sciex Instruments |
| Model | 1024945-AC |
| Serial Number | AU23121005 |
| Time from start = 0.0333 min Mass Spectrometer QTRAP 5500 0 | |
| Start of Run - Detailed Status | |
| Vacuum Status | At Pressure |
| Vacuum Gauge (10e−5 Torr) | 2.7 |
| Backing Pump | Ok |
| Interface Pump | Bad |
| Curtain Gas | Bad |
| Interface Turbo Pump | Normal |
| Analyzer Turbo Pump | Off |
| Sample Introduction Status | Ready |
| Source/Ion Path Electronics | On |
| Source Type | Turbo Spray |
| Source Temperature (at setpoint) | 500.0 C. |
| Source Exhaust Pump | On |
| Injection Manifold | Bypass |
| Time from start = 0.0333 min Mass Spectrometer QTRAP 5500 0 | |

-continued

| End of Run - Detailed Status | |
|---|---|
| Vacuum Status | At Pressure |
| Vacuum Gauge (10e−5 Torr) | 2.7 |
| Backing Pump | Ok |
| Interface Pump | Bad |
| Curtain Gas | Bad |
| Interface Turbo Pump | Normal |
| Analyzer Turbo Pump | Off |
| Sample Introduction Status | Ready |
| Source/Ion Path Electronics | On |
| Source Type | Turbo Spray |
| Source Temperature (at setpoint) | 499.0 C. |
| Source Exhaust Pump | On |
| Injection Manifold | Bypass |
| Time from start = 19.4333 min | |

| Acquisition Info | |
|---|---|
| Acquisition Method: | \UnipathII_29ISpeptides_test_2.dam |
| Acquisition Path: | D:\Analyst Data\Projects\UnipathII\Acquisition Methods\ |
| First Sample Started: | Friday, April 13, 2012 2:41:22 PM |
| Last Sample Finished: | Friday, April 13, 2012 5:16:47 PM |
| Sample Acq Time: | Friday, April 13, 2012 3:59:04 PM |
| Sample Acq Duration: | 19 min0 sec |
| Number of Scans: | 0 |
| Periods in File: | 1 |
| Batch Name: | \20120413-4.dab |
| Batch Path: | D:\Analyst Data\Projects\UnipathII\Batch\D:\Analyst Data\Projects\UnipathII\Batch\ |
| Submitted by: | JVELABFFW\Administrator( ) |
| Logged-on User: | JVELABFFW\Administrator |
| Synchronization Mode: | LC Sync |
| Auto-Equilibration: | Off |
| Comment: | Column: Waters: XBridge BEH130 C18 3.5 um 100 × 2.1 mm A: H2O/0.1% FA B: ACN/0.1% FA |
| Software Version: | Analyst 1.5.2 |
| Set Name: | 20120413 |
| Sample Name | IS003 |

| Sample ID | |
|---|---|
| Sample Comments: | MPX_SAMPLE_ID: 87; Stream Number: 2; Plate Code: 1.5 mL Cooled; Injection Volume: 10; |
| Autosampler Vial: | 69 |
| Rack Code: | 1.5 mL Cooled Rack Position: 1 |
| Plate Code: | 1.5 mL Cooled |
| Plate Position | 1 |

| Software Application Properties | |
|---|---|
| Display Name: | MPX Driver |
| Identifier Key: | {5EFDDCE0-DE4E-47FC-BF24-A45EB700B648} |
| Method Filename: | None |

Method Data:
Stream Options

| Inject Sample on Stream Number: | 2 |
|---|---|

Loading Pump

| Loading Pump Flow Rate: | 0.2 mL/min |
|---|---|
| Sample Equilibration Duration: | 5 sec |
| Sample Equilibration Channel: | A |
| Sample Loading Duration: | 5 sec |
| Sample Loading Channel: | A |

Sample Handling

| Default Injection Volume: | 10 uL |
|---|---|
| Cooling Enabled: | Yes |
| Cooling Temperature Set Point: | 15 degrees Celsius |
| Needle Stroke: | 2 mm |

Gradient Pump
Gradient Table

| | | |
|---|---|---|
| 0 | 2 | 0.2 |
| 0.5 | 2 | 0.2 |
| 16 | 36 | 0.2 |
| 19 | 40 | 0.2 |
| 19.5 | 90 | 0.2 |

| | | |
|---|---|---|
| 22.5 | 90 | 0.2 |
| 23 | 2 | 0.2 |
| 30 | 2 | 0.2 |

Column Oven

Oven Set Point: 36 degrees Celsius

Acquisition Window

Start Time: 2 min.
End Time: 21 min.

Other Options

Needle Dip Time: 2 sec
AutoSampler Rinse Volume: 500 uL
AutoSampler Rinse Speed: 35 uL/sec
AutoSampler Rinse Mode: 2
Sampling Speed: 5 uL/sec
Error Recovery Policy: Continue running other streams and abort samples on the failed stream.

Valco Valve Diverter

| Total | Time (min) | Position |
|---|---|---|
| 1 | 0.1 | A |

Quantitation Information:

Sample Type: Unknown
Dilution Factor: 1.000000

Custom Data:

Acq. Start Time (min) Injection Volume used
2 10

Quantitation Table:
Period 1:

Scans in Period: 735
Relative Start Time: 0.00 msec
Experiments in Period: 1
Period 1 Experiment 1:
Scan Type: MRM (MRM)
Scheduled MRM: No
Polarity: Positive
Scan Mode: N/A
Ion Source: Turbo Spray
Resolution Q1: Unit
Resolution Q3: Unit
Intensity Thres.: 0.00 cps
Settling Time: 0.0000 msec
MR Pause: 5.0070 msec
MCA: No
Step Size: 0.00 Da

| Q1 Mass (Da) | Q3 Mass (Da) | Dwell (msec) | Param | Start | Stop | ID |
|---|---|---|---|---|---|---|
| 639.900 | 213.100 | 5.00 | DP | 66.00 | 66.00 | EXTL2-1_b2, IV_h |
| | | CE | 31.00 | 31.00 | | |
| | | CXP | 18.00 | 18.00 | | |
| 639.900 | 868.300 | 5.00 | DP | 66.00 | 66.00 | EXTL2-1_y7, IVVWNNIG (SEQ ID NO: 1290)-28_h |
| | | CE | 29.00 | 29.00 | | |
| | | CXP | 24.00 | 24.00 | | |
| 639.900 | 312.200 | 5.00 | DP | 66.00 | 66.00 | EXTL2-1_b3, IVV_h |
| | | CE | 27.00 | 27.00 | | |
| | | CXP | 28.00 | 28.00 | | |
| 639.900 | 1066.400 | 5.00 | DP | 66.00 | 66.00 | EXTL2-1_y9_h |
| | | CE | 25.00 | 25.00 | | |
| | | CXP | 28.00 | 28.00 | | |
| 639.900 | 967.400 | 5.00 | DP | 66.00 | 66.00 | EXTL2-1_y8_h |
| | | CE | 27.00 | 27.00 | | |
| | | CXP | 26.00 | 26.00 | | |
| 713.600 | 689.600 | 5.00 | DP | 151.00 | 151.00 | EXTL2-2_y18_+3_h |
| | | CE | 31.00 | 31.00 | | |
| | | CXP | 18.00 | 18.00 | | |
| 713.600 | 806.800 | 5.00 | DP | 151.00 | 151.00 | EXTL2-2_y14_+2_h |
| | | CE | 31.00 | 31.00 | | |
| | | CXP | 22.00 | 22.00 | | |

| | | | | | | |
|---|---|---|---|---|---|---|
| 713.600 | 302.100 | 5.00 | DP | 151.00 | 151.00 | EXTL2-2_y2_h |
| | CE | 41.00 | 41.00 | | | |
| | CXP | 24.00 | 24.00 | | | |
| 713.600 | 213.100 | 5.00 | DP | 151.00 | 151.00 | EXTL2-2_PD, IV_h |
| | CE | 45.00 | 45.00 | | | |
| | CXP | 16.00 | 16.00 | | | |
| 713.600 | 341.900 | 5.00 | DP | 151.00 | 151.00 | EXTL2-2_PDE_h |
| | CE | 45.00 | 45.00 | | | |
| | CXP | 30.00 | 30.00 | | | |
| 489.800 | 702.200 | 5.00 | DP | 71.00 | 71.00 | EXTL2-3_y5_h |
| | CE | 21.00 | 21.00 | | | |
| | CXP | 18.00 | 18.00 | | | |
| 489.800 | 249.100 | 5.00 | DP | 71.00 | 71.00 | EXTL2-3_a2_h |
| | CE | 25.00 | 25.00 | | | |
| | CXP | 26.00 | 26.00 | | | |
| 489.800 | 277.100 | 5.00 | DP | 71.00 | 71.00 | EXTL2-3_b2_h |
| | CE | 21.00 | 21.00 | | | |
| | CXP | 24.00 | 24.00 | | | |
| 489.800 | 573.200 | 5.00 | DP | 71.00 | 71.00 | EXTL2-3_y4_h |
| | CE | 25.00 | 25.00 | | | |
| | CXP | 16.00 | 16.00 | | | |
| 489.800 | 460.100 | 5.00 | DP | 71.00 | 71.00 | EXTL2-3_y3_h |
| | CE | 23.00 | 23.00 | | | |
| | CXP | 40.00 | 40.00 | | | |
| 519.100 | 616.200 | 5.00 | DP | 81.00 | 81.00 | EXTL2-4_y5_h |
| | CE | 23.00 | 23.00 | | | |
| | CXP | 18.00 | 18.00 | | | |
| 519.100 | 840.300 | 5.00 | DP | 81.00 | 81.00 | EXTL2-4_b7_h |
| | CE | 21.00 | 21.00 | | | |
| | CXP | 22.00 | 22.00 | | | |
| 519.100 | 292.100 | 5.00 | DP | 81.00 | 81.00 | EXTL2-4_y2, YQ_h |
| | CE | 33.00 | 33.00 | | | |
| | CXP | 26.00 | 26.00 | | | |
| 519.100 | 212.100 | 5.00 | DP | 81.00 | 81.00 | EXTL2-4_PN_h |
| | CE | 41.00 | 41.00 | | | |
| | CXP | 20.00 | 20.00 | | | |
| 519.100 | 308.700 | 5.00 | DP | 81.00 | 81.00 | EXTL2-4_y5_+2_h |
| | CE | 23.00 | 23.00 | | | |
| | CXP | 26.00 | 26.00 | | | |
| 456.800 | 718.200 | 5.00 | DP | 71.00 | 71.00 | S100A12-1_y6_h |
| | CE | 23.00 | 23.00 | | | |
| | CXP | 20.00 | 20.00 | | | |
| 456.800 | 242.100 | 5.00 | DP | 71.00 | 71.00 | S100A12-1_y2_h |
| | CE | 29.00 | 29.00 | | | |
| | CXP | 22.00 | 22.00 | | | |
| 456.800 | 439.200 | 5.00 | DP | 71.00 | 71.00 | S100A12-1_b4-H2O, y4-NH3_h |
| | CE | 23.00 | 23.00 | | | |
| | CXP | 12.00 | 12.00 | | | |
| 456.800 | 263.100 | 5.00 | DP | 71.00 | 71.00 | S100A12-1_FD_h |
| | CE | 37.00 | 37.00 | | | |
| | CXP | 22.00 | 22.00 | | | |
| 456.800 | 224.100 | 5.00 | DP | 71.00 | 71.00 | S100A12-1_y2-H2O_h |
| | CE | 31.00 | 31.00 | | | |
| | CXP | 20.00 | 20.00 | | | |
| 486.800 | 477.800 | 5.00 | DP | 146.00 | 146.00 | S100A12-2_MH-H2O_+2_h |
| | CE | 21.00 | 21.00 | | | |
| | CXP | 14.00 | 14.00 | | | |
| 486.800 | 415.700 | 5.00 | DP | 146.00 | 146.00 | S100A12-2_y6_+2_h |
| | CE | 25.00 | 25.00 | | | |
| | CXP | 12.00 | 12.00 | | | |
| 486.800 | 280.100 | 5.00 | DP | 146.00 | 146.00 | S100A12-2_b3_h |
| | CE | 29.00 | 29.00 | | | |
| | CXP | 22.00 | 22.00 | | | |
| 486.800 | 301.100 | 5.00 | DP | 146.00 | 146.00 | S100A12-2_HY, YH_h |
| | CE | 41.00 | 41.00 | | | |
| | CXP | 28.00 | 28.00 | | | |
| 486.800 | 693.100 | 5.00 | DP | 146.00 | 146.00 | S100A12-2_y5_h |
| | CE | 25.00 | 25.00 | | | |
| | CXP | 54.00 | 54.00 | | | |
| 398.800 | 389.700 | 5.00 | DP | 51.00 | 51.00 | S100A12-3_MH-H2O_+2_h |
| | CE | 11.00 | 11.00 | | | |
| | CXP | 10.00 | 10.00 | | | |
| 398.800 | 554.100 | 5.00 | DP | 51.00 | 51.00 | S100A12-3_y5_h |
| | CE | 19.00 | 19.00 | | | |
| | CXP | 16.00 | 16.00 | | | |
| 398.800 | 483.100 | 5.00 | DP | 51.00 | 51.00 | S100A12-3_y4_h |
| | CE | 17.00 | 17.00 | | | |
| | CXP | 40.00 | 40.00 | | | |

-continued

| | | | | | | |
|---|---|---|---|---|---|---|
| 398.800 | 369.200 | 5.00 | DP | 51.00 | 51.00 | S100A12-3_y3_h |
| | CE | 17.00 | 17.00 | | | |
| | CXP | 32.00 | 32.00 | | | |
| 398.800 | 215.100 | 5.00 | DP | 51.00 | 51.00 | S100A12-3_a2, TI_h |
| | CE | 25.00 | 25.00 | | | |
| | CXP | 18.00 | 18.00 | | | |
| 570.300 | 453.300 | 5.00 | DP | 51.00 | 51.00 | TMPS4-1_y9_+2_h |
| | CE | 23.00 | 23.00 | | | |
| | CXP | 12.00 | 12.00 | | | |
| 570.300 | 679.300 | 5.00 | DP | 51.00 | 51.00 | TMPS4-1_y7_h |
| | CE | 33.00 | 33.00 | | | |
| | CXP | 18.00 | 18.00 | | | |
| 570.300 | 905.400 | 5.00 | DP | 51.00 | 51.00 | TMPS4-1_y9_h |
| | CE | 27.00 | 27.00 | | | |
| | CXP | 24.00 | 24.00 | | | |
| 570.300 | 808.300 | 5.00 | DP | 51.00 | 51.00 | TMPS4-1_y8_h |
| | CE | 33.00 | 33.00 | | | |
| | CXP | 22.00 | 22.00 | | | |
| 570.300 | 622.200 | 5.00 | DP | 51.00 | 51.00 | TMPS4-1_y6, PEGPAVA (SEQ ID NO: 1291)_h |
| | CE | 33.00 | 33.00 | | | |
| | CXP | 16.00 | 16.00 | | | |
| 549.300 | 693.300 | 5.00 | DP | 61.00 | 61.00 | TMPS4-2_y7_h |
| | CE | 25.00 | 25.00 | | | |
| | CXP | 18.00 | 18.00 | | | |
| 549.300 | 540.100 | 5.00 | DP | 61.00 | 61.00 | TMPS4-2_MH-H2O_+2_h |
| | CE | 21.00 | 21.00 | | | |
| | CXP | 14.00 | 14.00 | | | |
| 549.300 | 369.000 | 5.00 | DP | 61.00 | 61.00 | TMPS4-2_PSLA (SEQ ID NO: 1292)_h |
| | CE | 39.00 | 39.00 | | | |
| | CXP | 10.00 | 10.00 | | | |
| 549.300 | 347.200 | 5.00 | DP | 61.00 | 61.00 | TMPS4-2_y7_+2_h |
| | CE | 29.00 | 29.00 | | | |
| | CXP | 10.00 | 10.00 | | | |
| 549.300 | 377.200 | 5.00 | DP | 61.00 | 61.00 | TMPS4-2_a4_h |
| | CE | 25.00 | 25.00 | | | |
| | CXP | 32.00 | 32.00 | | | |
| 688.500 | 987.400 | 5.00 | DP | 61.00 | 61.00 | TMPS4-3_y9_h |
| | CE | 29.00 | 29.00 | | | |
| | CXP | 26.00 | 26.00 | | | |
| 688.500 | 389.200 | 5.00 | DP | 61.00 | 61.00 | TMPS4-3_b3, y7_+2_h |
| | CE | 27.00 | 27.00 | | | |
| | CXP | 36.00 | 36.00 | | | |
| 688.500 | 567.800 | 5.00 | DP | 61.00 | 61.00 | TMPS4-3_y10_+2_h |
| | CE | 29.00 | 29.00 | | | |
| | CXP | 16.00 | 16.00 | | | |
| 688.500 | 1134.500 | 5.00 | DP | 61.00 | 61.00 | TMPS4-3_y10_h |
| | CE | 27.00 | 27.00 | | | |
| | CXP | 30.00 | 30.00 | | | |
| 688.500 | 777.300 | 5.00 | DP | 61.00 | 61.00 | TMPS4-3_y7_h |
| | CE | 39.00 | 39.00 | | | |
| | CXP | 22.00 | 22.00 | | | |
| 527.800 | 518.600 | 5.00 | DP | 61.00 | 61.00 | TMPS4-4_MH-H2O_+2_h |
| | CE | 23.00 | 23.00 | | | |
| | CXP | 14.00 | 14.00 | | | |
| 527.800 | 341.100 | 5.00 | DP | 61.00 | 61.00 | TMPS4-4_y2_h |
| | CE | 29.00 | 29.00 | | | |
| | CXP | 26.00 | 26.00 | | | |
| 527.800 | 917.200 | 5.00 | DP | 61.00 | 61.00 | TMPS4-4_y7, c7_h |
| | CE | 21.00 | 21.00 | | | |
| | CXP | 24.00 | 24.00 | | | |
| 527.800 | 816.300 | 5.00 | DP | 61.00 | 61.00 | TMPS4-4_y6_h |
| | CE | 23.00 | 23.00 | | | |
| | CXP | 22.00 | 22.00 | | | |
| 527.800 | 714.100 | 5.00 | DP | 61.00 | 61.00 | TMPS4-4_b6_h |
| | CE | 27.00 | 27.00 | | | |
| | CXP | 20.00 | 20.00 | | | |
| 521.800 | 872.300 | 5.00 | DP | 56.00 | 56.00 | CSRP1-1_y8_h |
| | CE | 21.00 | 21.00 | | | |
| | CXP | 24.00 | 24.00 | | | |
| 521.800 | 743.300 | 5.00 | DP | 56.00 | 56.00 | CSRP1-1_y7_h |
| | CE | 23.00 | 23.00 | | | |
| | CXP | 20.00 | 20.00 | | | |
| 521.800 | 512.700 | 5.00 | DP | 56.00 | 56.00 | CSRP1-1_MH-H2O_+2_h |
| | CE | 19.00 | 19.00 | | | |
| | CXP | 4.00 | 4.00 | | | |

-continued

| | | | | | |
|---|---|---|---|---|---|
| 521.800 | 341.100 | 5.00 | DP | 56.00 | 56.00 CSRP1-1_y3_h |
| | CE | 35.00 | | 35.00 | |
| | CXP | 30.00 | | 30.00 | |
| 521.800 | 300.200 | 5.00 | DP | 56.00 | 56.00 CSRP1-1_b3, LAD_h |
| | CE | 21.00 | | 21.00 | |
| | CXP | 26.00 | | 26.00 | |
| 741.900 | 857.300 | 5.00 | DP | 116.00 | 116.00 CSRP1-2_y9_h |
| | CE | 35.00 | | 35.00 | |
| | CXP | 24.00 | | 24.00 | |
| 741.900 | 1042.400 | 5.00 | DP | 116.00 | 116.00 CSRP1-2_y11, c11_h |
| | CE | 33.00 | | 33.00 | |
| | CXP | 28.00 | | 28.00 | |
| 741.900 | 732.800 | 5.00 | DP | 116.00 | 116.00 CSRP1-2_MH-H2O_+2_h |
| | CE | 29.00 | | 29.00 | |
| | CXP | 20.00 | | 20.00 | |
| 741.900 | 729.100 | 5.00 | DP | 116.00 | 116.00 CSRP1-2_y7_h |
| | CE | 35.00 | | 35.00 | |
| | CXP | 20.00 | | 20.00 | |
| 741.900 | 413.000 | 5.00 | DP | 116.00 | 116.00 CSRP1-2_a4, YGYG (SEQ ID NO: 1293)-28_h |
| | CE | 33.00 | | 33.00 | |
| | CXP | 12.00 | | 12.00 | |
| 449.800 | 328.700 | 5.00 | DP | 46.00 | 46.00 S100A4-1_y6_+2_h |
| | CE | 19.00 | | 19.00 | |
| | CXP | 10.00 | | 10.00 | |
| 449.800 | 656.200 | 5.00 | DP | 46.00 | 46.00 S100A4-1_y6_h |
| | CE | 17.00 | | 17.00 | |
| | CXP | 18.00 | | 18.00 | |
| 449.800 | 440.800 | 5.00 | DP | 46.00 | 46.00 S100A4-1_MH-H2O_+2_h |
| | CE | 13.00 | | 13.00 | |
| | CXP | 14.00 | | 14.00 | |
| 449.800 | 559.200 | 5.00 | DP | 46.00 | 46.00 S100A4-1_y5_h |
| | CE | 25.00 | | 25.00 | |
| | CXP | 16.00 | | 16.00 | |
| 449.800 | 332.100 | 5.00 | DP | 46.00 | 46.00 S100A4-1_PSF_h |
| | CE | 31.00 | | 31.00 | |
| | CXP | 30.00 | | 30.00 | |
| 459.300 | 347.100 | 5.00 | DP | 121.00 | 121.00 S100A4-2_AFQ_h |
| | CE | 27.00 | | 27.00 | |
| | CXP | 30.00 | | 30.00 | |
| 459.300 | 346.200 | 5.00 | DP | 121.00 | 121.00 S100A4-2_b3_h |
| | CE | 19.00 | | 19.00 | |
| | CXP | 8.00 | | 8.00 | |
| 459.300 | 701.300 | 5.00 | DP | 121.00 | 121.00 S100A4-2_y6_h |
| | CE | 19.00 | | 19.00 | |
| | CXP | 18.00 | | 18.00 | |
| 459.300 | 572.200 | 5.00 | DP | 121.00 | 121.00 S100A4-2_y5_h |
| | CE | 21.00 | | 21.00 | |
| | CXP | 46.00 | | 46.00 | |
| 459.300 | 501.200 | 5.00 | DP | 121.00 | 121.00 S100A4-2_y4_h |
| | CE | 21.00 | | 21.00 | |
| | CXP | 12.00 | | 12.00 | |
| 646.300 | 916.400 | 5.00 | DP | 71.00 | 71.00 SH3L1-1_y10_h |
| | CE | 31.00 | | 31.00 | |
| | CXP | 26.00 | | 26.00 | |
| 646.300 | 845.400 | 5.00 | DP | 71.00 | 71.00 SH3L1-1_y9_h |
| | CE | 29.00 | | 29.00 | |
| | CXP | 24.00 | | 24.00 | |
| 646.300 | 376.200 | 5.00 | DP | 71.00 | 71.00 SH3L1-1_b3, SGSTA (SEQ ID NO: 1294)-28_h |
| | CE | 27.00 | | 27.00 | |
| | CXP | 12.00 | | 12.00 | |
| 646.300 | 1029.600 | 5.00 | DP | 71.00 | 71.00 SH3L1-1_y11_h |
| | CE | 25.00 | | 25.00 | |
| | CXP | 30.00 | | 30.00 | |
| 646.300 | 447.200 | 5.00 | DP | 71.00 | 71.00 SH3L1-1_b4_h |
| | CE | 25.00 | | 25.00 | |
| | CXP | 38.00 | | 38.00 | |
| 646.300 | 758.200 | 5.00 | DP | 71.00 | 71.00 SH3L1-1_y8_h |
| | CE | 25.00 | | 25.00 | |
| | CXP | 20.00 | | 20.00 | |
| 619.800 | 493.200 | 5.00 | DP | 56.00 | 56.00 SH3L1-2_y5, TAPPGS (SEQ ID NO: 1295)-H2O_h |
| | CE | 35.00 | | 35.00 | |
| | CXP | 14.00 | | 14.00 | |
| 619.800 | 665.200 | 5.00 | DP | 56.00 | 56.00 SH3L1-2_y7, y13_+2, YAFLGL (SEQ ID NO: 1296), AVYAFL (SEQ ID NO: 1297)_h |

-continued

| | | | | | | |
|---|---|---|---|---|---|---|
| | CE | 21.00 | 21.00 | | | |
| | CXP | 18.00 | 18.00 | | | |
| 619.800 | 673.800 | 5.00 | DP | 56.00 | 56.00 | SH3L1-2_b6-H2O_h |
| | CE | 17.00 | 17.00 | | | |
| | CXP | 18.00 | 18.00 | | | |
| 619.800 | 835.300 | 5.00 | DP | 56.00 | 56.00 | SH3L1-2_y9, AVYAFLGL (SEQ ID NO: 1298)_h |
| | CE | 25.00 | 25.00 | | | |
| | CXP | 22.00 | 22.00 | | | |
| 619.800 | 564.200 | 5.00 | DP | 56.00 | 56.00 | SH3L1-2_y6_h |
| | CE | 21.00 | 21.00 | | | |
| | CXP | 16.00 | 16.00 | | | |
| 600.800 | 679.100 | 5.00 | DP | 71.00 | 71.00 | SH3L1-4_y5_h |
| | CE | 25.00 | 25.00 | | | |
| | CXP | 18.00 | 18.00 | | | |
| 600.800 | 522.200 | 5.00 | DP | 71.00 | 71.00 | SH3L1-4_b5_h |
| | CE | 21.00 | 21.00 | | | |
| | CXP | 14.00 | 14.00 | | | |
| 600.800 | 532.000 | 5.00 | DP | 71.00 | 71.00 | SH3L1-4_y4_h |
| | CE | 25.00 | 25.00 | | | |
| | CXP | 46.00 | 46.00 | | | |
| 600.800 | 750.400 | 5.00 | DP | 71.00 | 71.00 | SH3L1-4_y6_h |
| | CE | 29.00 | 29.00 | | | |
| | CXP | 22.00 | 22.00 | | | |
| 600.800 | 865.200 | 5.00 | DP | 71.00 | 71.00 | SH3L1-4_y7_h |
| | CE | 29.00 | 29.00 | | | |
| | CXP | 24.00 | 24.00 | | | |
| 378.200 | 299.200 | 5.00 | DP | 41.00 | 41.00 | S100A6-1_y3_h |
| | CE | 15.00 | 15.00 | | | |
| | CXP | 8.00 | 8.00 | | | |
| 378.200 | 369.300 | 5.00 | DP | 41.00 | 41.00 | S100A6-1_MH-H2O_+2_h |
| | CE | 11.00 | 11.00 | | | |
| | CXP | 10.00 | 10.00 | | | |
| 378.200 | 369.500 | 5.00 | DP | 41.00 | 41.00 | S100A6-1_MH-NH3_+2_h |
| | CE | 11.00 | 11.00 | | | |
| | CXP | 10.00 | 10.00 | | | |
| 378.200 | 513.100 | 5.00 | DP | 41.00 | 41.00 | S100A6-1_y5_h |
| | CE | 17.00 | 17.00 | | | |
| | CXP | 54.00 | 54.00 | | | |
| 378.200 | 412.000 | 5.00 | DP | 41.00 | 41.00 | S100A6-1_y4_h |
| | CE | 17.00 | 17.00 | | | |
| | CXP | 38.00 | 38.00 | | | |
| 463.300 | 684.100 | 5.00 | DP | 71.00 | 71.00 | S100A6-2_y6_h |
| | CE | 21.00 | 21.00 | | | |
| | CXP | 18.00 | 18.00 | | | |
| 463.300 | 569.100 | 5.00 | DP | 71.00 | 71.00 | S100A6-2_y5_h |
| | CE | 27.00 | 27.00 | | | |
| | CXP | 14.00 | 14.00 | | | |
| 463.300 | 795.100 | 5.00 | DP | 71.00 | 71.00 | S100A6-2_y7-NH3_h |
| | CE | 23.00 | 23.00 | | | |
| | CXP | 22.00 | 22.00 | | | |
| 463.300 | 454.700 | 5.00 | DP | 71.00 | 71.00 | S100A6-2_MH-NH3_+2_h |
| | CE | 19.00 | 19.00 | | | |
| | CXP | 12.00 | 12.00 | | | |
| 463.300 | 369.300 | 5.00 | DP | 71.00 | 71.00 | S100A6-2_y3_h |
| | CE | 31.00 | 31.00 | | | |
| | CXP | 32.00 | 32.00 | | | |
| 491.700 | 732.200 | 5.00 | DP | 96.00 | 96.00 | CNDP1-1_y6_h |
| | CE | 25.00 | 25.00 | | | |
| | CXP | 20.00 | 20.00 | | | |
| 491.700 | 594.200 | 5.00 | DP | 96.00 | 96.00 | CNDP1-1_b5_h |
| | CE | 31.00 | 31.00 | | | |
| | CXP | 16.00 | 16.00 | | | |
| 491.700 | 845.300 | 5.00 | DP | 96.00 | 96.00 | CNDP1-1_y7, c7_h |
| | CE | 25.00 | 25.00 | | | |
| | CXP | 22.00 | 22.00 | | | |
| 491.700 | 362.200 | 5.00 | DP | 96.00 | 96.00 | CNDP1-1_b3-H2O, b6-H2O_+2, DVF_h |
| | CE | 43.00 | 43.00 | | | |
| | CXP | 10.00 | 10.00 | | | |
| 491.700 | 389.100 | 5.00 | DP | 96.00 | 96.00 | CNDP1-1_y3_h |
| | CE | 31.00 | 31.00 | | | |
| | CXP | 38.00 | 38.00 | | | |
| 624.300 | 578.300 | 5.00 | DP | 66.00 | 66.00 | CNDP1-2_y5_h |
| | CE | 29.00 | 29.00 | | | |
| | CXP | 16.00 | 16.00 | | | |
| 624.300 | 311.000 | 5.00 | DP | 66.00 | 66.00 | CNDP1-2_PVN_h |
| | CE | 47.00 | 47.00 | | | |
| | CXP | 26.00 | 26.00 | | | |

-continued

| | | | | | | |
|---|---|---|---|---|---|---|
| 624.300 | 806.300 | 5.00 | DP | 66.00 | 66.00 | CNDP1-2_y7_h |
| | CE | 29.00 | 29.00 | | | |
| | CXP | 22.00 | 22.00 | | | |
| 624.300 | 532.200 | 5.00 | DP | 66.00 | 66.00 | CNDP1-2_y9_+2_h |
| | CE | 25.00 | 25.00 | | | |
| | CXP | 14.00 | 14.00 | | | |
| 624.300 | 670.200 | 5.00 | DP | 66.00 | 66.00 | CNDP1-2_b6_h |
| | CE | 23.00 | 23.00 | | | |
| | CXP | 18.00 | 18.00 | | | |
| 504.700 | 490.200 | 5.00 | DP | 66.00 | 66.00 | CNDP1-3_y4_h |
| | CE | 21.00 | 21.00 | | | |
| | CXP | 14.00 | 14.00 | | | |
| 504.700 | 589.200 | 5.00 | DP | 66.00 | 66.00 | CNDP1-3_y5_h |
| | CE | 23.00 | 23.00 | | | |
| | CXP | 16.00 | 16.00 | | | |
| 504.700 | 774.300 | 5.00 | DP | 66.00 | 66.00 | CNDP1-3_y7_h |
| | CE | 27.00 | 27.00 | | | |
| | CXP | 22.00 | 22.00 | | | |
| 504.700 | 660.300 | 5.00 | DP | 66.00 | 66.00 | CNDP1-3_y6_h |
| | CE | 25.00 | 25.00 | | | |
| | CXP | 18.00 | 18.00 | | | |
| 756.100 | 1073.400 | 5.00 | DP | 131.00 | 131.00 | CNDP1-3_y9, LAWINAVSAF (SEQ ID NO: 1299)_h |
| | CE | 35.00 | 35.00 | | | |
| | CXP | 28.00 | 28.00 | | | |
| 756.100 | 774.300 | 5.00 | DP | 131.00 | 131.00 | CNDP1-3_y7_h |
| | CE | 35.00 | 35.00 | | | |
| | CXP | 20.00 | 20.00 | | | |
| 756.100 | 887.400 | 5.00 | DP | 131.00 | 131.00 | CNDP1-3_y8_h |
| | CE | 35.00 | 35.00 | | | |
| | CXP | 24.00 | 24.00 | | | |
| 756.100 | 1144.500 | 5.00 | DP | 131.00 | 131.00 | CNDP1-3_y10, VLAWINAVSAF (SEQ ID NO: 1300)-28_h |
| | CE | 37.00 | 37.00 | | | |
| | CXP | 30.00 | 30.00 | | | |
| 756.100 | 438.200 | 5.00 | DP | 131.00 | 131.00 | CNDP1-3_b5_h |
| | CE | 33.00 | 33.00 | | | |
| | CXP | 34.00 | 34.00 | | | |
| 634.800 | 542.700 | 5.00 | DP | 101.00 | 101.00 | CNDP1-4_y8_+2, b9_+2_h |
| | CE | 31.00 | 31.00 | | | |
| | CXP | 14.00 | 14.00 | | | |
| 634.800 | 834.300 | 5.00 | DP | 101.00 | 101.00 | CNDP1-4_y6_h |
| | CE | 35.00 | 35.00 | | | |
| | CXP | 22.00 | 22.00 | | | |
| 634.800 | 322.100 | 5.00 | DP | 101.00 | 101.00 | CNDP1-4_b3_h |
| | CE | 35.00 | 35.00 | | | |
| | CXP | 26.00 | 26.00 | | | |
| 634.800 | 947.400 | 5.00 | DP | 101.00 | 101.00 | CNDP1-4_y7_h |
| | CE | 33.00 | 33.00 | | | |
| | CXP | 24.00 | 24.00 | | | |
| 634.800 | 348.200 | 5.00 | DP | 101.00 | 101.00 | CNDP1-4_y2, HLD-H2O_h |
| | CE | 45.00 | 45.00 | | | |
| | CXP | 30.00 | 30.00 | | | |
| 672.800 | 586.500 | 5.00 | DP | 101.00 | 101.00 | THIO-1_y11_+2_h |
| | CE | 29.00 | 29.00 | | | |
| | CXP | 16.00 | 16.00 | | | |
| 672.800 | 897.200 | 5.00 | DP | 101.00 | 101.00 | THIO-1_y9_h |
| | CE | 33.00 | 33.00 | | | |
| | CXP | 24.00 | 24.00 | | | |
| 672.800 | 768.300 | 5.00 | DP | 101.00 | 101.00 | THIO-1_y8_h |
| | CE | 33.00 | 33.00 | | | |
| | CXP | 20.00 | 20.00 | | | |
| 672.800 | 469.200 | 5.00 | DP | 101.00 | 101.00 | THIO-1_y5_h |
| | CE | 45.00 | 45.00 | | | |
| | CXP | 38.00 | 38.00 | | | |
| 672.800 | 584.000 | 5.00 | DP | 101.00 | 101.00 | THIO-1_y6_h |
| | CE | 37.00 | 37.00 | | | |
| | CXP | 16.00 | 16.00 | | | |
| 458.800 | 817.200 | 5.00 | DP | 71.00 | 71.00 | THIO-2_y8_h |
| | CE | 21.00 | 21.00 | | | |
| | CXP | 22.00 | 22.00 | | | |
| 458.800 | 631.200 | 5.00 | DP | 71.00 | 71.00 | THIO-2_y6_h |
| | CE | 21.00 | 21.00 | | | |
| | CXP | 16.00 | 16.00 | | | |
| 458.800 | 484.100 | 5.00 | DP | 71.00 | 71.00 | THIO-2_y5_h |
| | CE | 23.00 | 23.00 | | | |
| | CXP | 14.00 | 14.00 | | | |

-continued

| | | | | | | |
|---|---|---|---|---|---|---|
| 458.800 | 760.100 | 5.00 | DP | 71.00 | 71.00 | THIO-2_y7_h |
| | CE | 19.00 | 19.00 | | | |
| | CXP | 20.00 | 20.00 | | | |
| 458.800 | 397.100 | 5.00 | DP | 71.00 | 71.00 | THIO-2_y4_h |
| | CE | 25.00 | 25.00 | | | |
| | CXP | 36.00 | 36.00 | | | |
| 874.100 | 312.100 | 5.00 | DP | 146.00 | 146.00 | THIO-3_b3_h |
| | CE | 39.00 | 39.00 | | | |
| | CXP | 26.00 | 26.00 | | | |
| 874.100 | 864.900 | 5.00 | DP | 146.00 | 146.00 | THIO-3_MH-H2O_+2_h |
| | CE | 29.00 | 29.00 | | | |
| | CXP | 22.00 | 22.00 | | | |
| 874.100 | 469.100 | 5.00 | DP | 146.00 | 146.00 | THIO-3_y4_h |
| | CE | 55.00 | 55.00 | | | |
| | CXP | 12.00 | 12.00 | | | |
| 874.100 | 629.100 | 5.00 | DP | 146.00 | 146.00 | THIO-3_y5, VVVDFS (SEQ ID NO: 1301)-H2O_h |
| | CE | 53.00 | 53.00 | | | |
| | CXP | 16.00 | 16.00 | | | |
| 874.100 | 1074.300 | 5.00 | DP | 146.00 | 146.00 | THIO-3_y9_h |
| | CE | 39.00 | 39.00 | | | |
| | CXP | 28.00 | 28.00 | | | |
| 583.100 | 576.900 | 5.00 | DP | 61.00 | 61.00 | THIO-3_ATWC (SEQ ID NO: 1302) (+57)G_h |
| | CE | 17.00 | 17.00 | | | |
| | CXP | 14.00 | 14.00 | | | |
| 583.100 | 758.800 | 5.00 | DP | 61.00 | 61.00 | THIO-3_y13-H2O_+2_h |
| | CE | 21.00 | 21.00 | | | |
| | CXP | 20.00 | 20.00 | | | |
| 583.100 | 767.900 | 5.00 | DP | 61.00 | 61.00 | THIO-3_y13_+2_h |
| | CE | 17.00 | 17.00 | | | |
| | CXP | 20.00 | 20.00 | | | |
| 583.100 | 469.200 | 5.00 | DP | 61.00 | 61.00 | THIO-3_y4_h |
| | CE | 35.00 | 35.00 | | | |
| | CXP | 14.00 | 14.00 | | | |
| 583.100 | 629.100 | 5.00 | DP | 61.00 | 61.00 | THIO-3_y5, VVVDFS (SEQ ID NO: 1301)-H2O_h |
| | CE | 29.00 | 29.00 | | | |
| | CXP | 54.00 | 54.00 | | | |
| 564.700 | 558.600 | 5.00 | DP | 56.00 | 56.00 | S100A1-1_FLDAQ (SEQ ID NO: 1303)-NH3_n |
| | CE | 15.00 | 15.00 | | | |
| | CXP | 6.00 | 6.00 | | | |
| 564.700 | 574.100 | 5.00 | DP | 56.00 | 56.00 | S100A1-1_y5_n |
| | CE | 25.00 | 25.00 | | | |
| | CXP | 16.00 | 16.00 | | | |
| 564.700 | 461.100 | 5.00 | DP | 56.00 | 56.00 | S100A1-1_y4_n |
| | CE | 27.00 | 27.00 | | | |
| | CXP | 38.00 | 38.00 | | | |
| 564.700 | 778.300 | 5.00 | DP | 56.00 | 56.00 | S100A1-1_y7_n |
| | CE | 25.00 | 25.00 | | | |
| | CXP | 22.00 | 22.00 | | | |
| 564.700 | 865.400 | 5.00 | DP | 56.00 | 56.00 | S100A1-1_y8_n |
| | CE | 25.00 | 25.00 | | | |
| | CXP | 22.00 | 22.00 | | | |
| 381.100 | 547.200 | 5.00 | DP | 51.00 | 51.00 | S100A1-2_y5_n |
| | CE | 15.00 | 15.00 | | | |
| | CXP | 14.00 | 14.00 | | | |
| 381.100 | 262.100 | 5.00 | DP | 51.00 | 51.00 | S100A1-2_y2_n |
| | CE | 27.00 | 27.00 | | | |
| | CXP | 8.00 | 8.00 | | | |
| 381.100 | 432.200 | 5.00 | DP | 51.00 | 51.00 | S100A1-2_y4_n |
| | CE | 19.00 | 19.00 | | | |
| | CXP | 12.00 | 12.00 | | | |
| 381.100 | 361.000 | 5.00 | DP | 51.00 | 51.00 | S100A1-2_y3_n |
| | CE | 23.00 | 23.00 | | | |
| | CXP | 26.00 | 26.00 | | | |
| 381.100 | 330.200 | 5.00 | DP | 51.00 | 51.00 | S100A1-2_b3_n |
| | CE | 17.00 | 17.00 | | | |
| | CXP | 26.00 | 26.00 | | | |

Parameter Table(Period 1 Experiment 1)

| | |
|---|---|
| CUR: | 30.00 |
| CAD: | Medium |
| IS: | 5000.00 |
| TEM: | 500.00 |
| GS1: | 40.00 |

-continued

| | |
|---|---|
| GS2: | 60.00 |
| EP | 10.00 |

Resolution tables
Quad 1 Positive Unit Scan Speed = 10 Da/s
Last Modification Date Time: October 03, 2011 11:56:39
IE1 1.000

| Mass (Da) | Offset Value |
|---|---|
| 59.050 | −0.250 |
| 175.133 | −0.630 |
| 500.380 | −1.695 |
| 616.464 | −2.045 |
| 906.673 | −3.040 |

Quad 3 Positive Unit Scan Speed = 10 Da/s
Last Modification Date Time: September 30, 2011 11:36:11
IE3 0.900

| Mass (Da) | Offset Value |
|---|---|
| 59.050 | −0.170 |
| 175.133 | −0.450 |
| 500.380 | −1.280 |
| 616.464 | −1.585 |
| 906.673 | −2.320 |

Calibration tables
Quad 1 Positive Unit Resolution Scan Speed = 10 Da/s
Last Modification Date Time: September 30, 2011 11:18:56

| Mass (Da) | Dac Value |
|---|---|
| 59.050 | 10826 |
| 175.133 | 32398 |
| 500.380 | 92858 |
| 616.464 | 114436 |
| 906.673 | 168380 |

Quad 3 Positive Unit Resolution Scan Speed = 10 Da/s
Last Modification Date Time: September 30, 2011 11:36:51

| Mass (Da) | Dac Value |
|---|---|
| 59.050 | 10797 |
| 175.133 | 32322 |
| 500.380 | 92649 |
| 616.464 | 114180 |
| 906.673 | 168004 |

Instrument Parameters:

| | |
|---|---|
| Detector Parameters (Positive): | CEM 2300.0 |
| Keyed Text: | File was created with the software version: Analyst 1.5.2 |

Exostosin-Like 2 (EXTL2) Accession No.

Q9UBQ6
(SEQ ID NO: 1107)

```
         10         20         30         40
MRCCHICKLP GRVMGIRVLR LSLVVILVLL LVAGALTALL 50         60         70         80
PSVKEDKMLM LRREIKSQGK STMDSFTLIM QTYNRTDLLL 90        100        110        120
KLLNHYQAVP NLHKVIVVWN NIGEKAPDEL WNSLGPHPIP 130        140        150        160
VIFKQQTANR MRNRLQVFPE LETNAVLMVD DDTLISTPDL 170        180        190        200
VFAFSVWQQF PDQIVGFVPR KHVSTSSGIY SYGSFEMQAP 210        220        230        240
GSGNGDQYSM VLIGASFFNS KYLELFQRQP AAVHALIDDT 250        260        270        280
QNCDDIAMNF IIAKHIGKTS GIFVKPVNMD NLEKETNSGY 290        300        310        320
SGMWHRAEHA LQRSYCINKL VNIYDSMPLR YSNIMISQFG

330
FPYANYKRKI
```

B4DNZ2
(SEQ ID NO: 1108)

```
         10         20         30         40
MGIRVLRLSL VVILVLLLVA GALTALLPSV KEDKMLMLRR 50         60         70         80
EIKSQGKSTM DSFTLIMQTY NRTDLLLKLL NHYQAVPNLH 90        100        110        120
```

-continued

```
                                        KVIVVWNNIG EKAPDELWNS LGPHPIPVIF KQQTANRMRN 130        140        150        160
RLQVFPELET NAVLMVDDDT LISTPDLVFA FSVWQQFPDQ 170        180        190        200
IVGFVPRKHV STSSGIYSYG SFEMQAPGSG NGDQYSMVLI 210        220        230        240
GASFFNSKYL ELFQRQPAAV HALIDDTQNC DDIAMNFIIA 250        260        270        280
KHIGKTSGIF VKPVNMDNLE KETNSGYSGM WHRAEHALQR 290        300        310
SYCINKLVNI YDSMPLRYSN IMISQLGFPY ANNKRKI
```

C9IYF5

(SEQ ID NO: 1109)

```
         10         20         30         40
MGIRVLRLSL VVILVLLLVA GALTALLPSV KEDKMLMLRR 50         60         70         80
EIKSQGKSTM DSFTLIMQTY NRTDLLLKLL NHYQAVPNLH 90        100        110
KVIVVWNNIG EKAPDELWNS LGPHPIPVIF KQQTANR
```

C9JEG3

(SEQ ID NO: 1110)

```
         10         20         30         40
MRTWNSGGTK CCHICKLPGR VMGIRVLRLS LVVILVLLLV 50         60         70         80
AGALTALLPS VKEDKMLMLR REIKSQGKST MDSFTLIMQT 90        100        110        120
YNRTDLLLKL LNHYQAVPNL HKVIVVWNNI GEKAPDELWN 130        140        150        160
SLGPHPIPVI FKQQTANRMR NRLQVFPELE TNAVLMVDDD 170        180        190        200
TLISTPDLVF AFSVWQQFPD QIVGFVPRKH VSTSSGIYSY 210        220        230        240
GSFEMQAPGS GNGDQYSMVL IGASFFNSKY LELFQRQPAA 250        260
VHALIDDTQN CDDIAMNFII AKHIGK
```

D3DT60

(SEQ ID NO: 1111)

```
         10         20         30         40
MRCCHICKLP GRVMGIRVLR LSLVVILVLL LVAGALTALL 50         60         70         80
PSVKEDKMLM LRREIKSQGK STMDSFTLIM QTYNRTDLLL 90        100        110        120
KLLNHYQAVP NLHKVIVVWN NIGEKAPDEL WNSLGPHPIP 130        140        150        160
VIFKQQTANR MRNRLQVFPE LETNAVLMVD DDTLISTPDL 170        180        190        200
VFAFSVWQQF PDQIVGFVPR KHVSTSSGIY SYGSFEMQAP 210        220        230        240
GSGNGDQYSM VLIGASFFNS KYLELFQRQP AAVHALIDDT 250        260        270        280
QNCDDIAMNF IIAKHIGKTS GIFVKPVNMD NLEKETNSGY 290        300        310        320
SGMWHRAEHA LQRSYCINKL VNIYDSMPLR YSNIMISQFG

330
FPYANYKRKI
```

Q05DH5

(SEQ ID NO: 1112)

```
         10         20         30         40
MRCCHICKLP GRVMGIRVLR LSLVVILVLL LVAGALTALL 50         60         70         80
PSVKEDKMLM LRREIKSQGK STMDSFTLIM QTYNRTDLLL 90        100        110        120
KLLNHYQAVP NLHKVIVVWN NIGEKAPDEL WNSLGPHPIP 130        140        150        160
VIFKQQTANR MRNRLQVFPE LETNAVLMVD DDTLISTPDL 170        180        190        200
VFAFSVWQQF PDQIVGFVPR KHVSTSSGIY SYGSFEMQAP 210        220        230        240
GSGNGDQYSM VLIGASFFNS KYLELFQRQP AAVHALIDDT 250        260        270        280
QNCDDIAMNF IIAKHIGKTS GIFVKPVNMD NLEKETNSGY 290        300        310        320
SGMWHRAEHA LQRSYCINKL VNIYDSMPLR YSNIMISQFG

333
FPYANYKKKK K
```

Q49A43

(SEQ ID NO: 1113)

```
         10         20         30         40
MRCCHICKLP GRVMGIRVLR LSLVVILVLL LVAGALTALL 50         60         70         80
PSVKEDKMLM LRREIKSQGK STMDSFTLIM QTYNRTDLLL 90        100        110        120
KLLNHYQAVP NLHKVIVVWN NIGEKAPDEL WNSLGPHPIP 130        140        150        160
VIFKQQTANR MRNRLQVFPE LETNAVLMVD DDTLISTTDL 170        180        190        200
VFAFSVWQQF PDQIVGFVPR KHVSTSSGIY SYGSFEMQAP 210        220        230        240
GSGNGDQYSM VLIGASFFNS KYLELFQRQP AAVHALIDDT 250        260        270        280
QNCDDIAMNF IIAKHIGKTS GIFVKPVNMD NLEKETNSGY 290        300        310        320
SGMWHRAEHA LQRSYCINKL VNIYDSMPLR YSNIMISQFG

330
FPYANYKRKI
```

Q8IYF4

(SEQ ID NO: 1114)

```
         10         20         30         40
MRCCHICKLP GRVMGIRVLR LSLVVILVLL LVAGALTALL 50         60         70         80
PSVKEDKMLM LRREIKSQGK STMDSFTLIM QTYNRTDLLL 90        100        110        120
KLLNHYQAVP NLHKVIVVWN NIGEKAPDEL WNSLGPHPIP 130        140        150        160
VIFKQQTANR MRNRLQVFPE LETNAVLMVD DDTLISTPDL 170        180        190        200
VFAFSVWQQF PDQIVGFVPR KHVSTSSGIY SYGSFEMQAP 210        220        230        240
GSGNGDQYSM VLIGASFFNS KYLELFQRQP AAVHALIDDT 250        260        270        280
QNCDDIAMNF IIAKHIGKTS GIFVKPVNMD NLEKETNSGY 290        300        310        320
```

```
-continued
SGMWHRAEHA LQRSYCINKL VNIYDSMPLR YSNITISQFG
        330
FPYANYKRKI Q8N8F1
                                    (SEQ ID NO: 1115)
        10         20         30         40
MRCCHICKLP GRVMGIRVLR LSLVVILVLL LVAGALTALL
        50         60         70         80
PSVKEDKMLM LRREIKSQGK STMDSFTLIM QTYNRTDLLL
        90        100        110        120
KLLNHYQAVP NLHKVIVVWN NIGEKAPDEL WNSLGPHPIP
       130        140        150        160
VIFKQQTANR MRNRLQVFPE LETNVLMVDD DTLISTPDLV
       170        180        190        200
FAFSVWQQFP DQIVGFVPRK HVSTSSGIYS YGSFEMQAPG
       210        220        230        240
SGNGDQYSMV LIGASFFNSK YLELFQRQPA AVHALIDDTQ
       250        260        270        280
NCDDIAMNFI IAKHIGKTSG IFVKPVNMDN LEKETNSGYS
       290        300        310        320
GMWHRAEHAL QRSYCINKLV NIYDSMPLRY SNIMISQFGF
PYANYKRKI
``` cDNA FLJ53119, Highly Similar to ADP-Ribosyl Cyclase 1 (EC 3.2.2.5) (CD38)

```
B4E006
                                    (SEQ ID NO: 1116)
        10         20         30         40
MANCEFSPVS GDKPCCRLSR IAQLCLGVSI LVLILVVVLA
        50         60         70         80
VVVPRWRQQW SGPGTTKRFP ETVLARCVKY TEIHPEMRHV
        90        100        110        120
DCQSVWDAFK GAFISKHPCN ITEEDYQPLM KLGTQTVPCN
       130        140        150        160
KKSTINLAQT GERTAATTLF QYSGKRFPAG LQKLPVMWSM
```

Protein S100-A12 (S100A12)

```
P80511
                                    (SEQ ID NO: 1117)
        10         20         30         40
MTKLEEHLEG IVNIFHQYSV RKGHFDTLSK GELKQLLTKE
        50         60         70         80
LANTIKNIKD KAVIDEIFQG LDANQDEQVD FQEFISLVAI
        90
ALKAAHYHTH KE
```

Cysteine and Glycine-Rich Protein 1 (CSRP1)

```
P21291
                                    (SEQ ID NO: 1118)
        10         20         30         40
MPNWGGGKKC GVCQKTVYFA EEVQCEGNSF HKSCFLCMVC
        50         60         70         80
KKNLDSTTVA VHGEEIYCKS CYGKKYGPKG YGYGQGAGTL
        90        100        110        120
STDKGESLGI KHEEAPGHRP TTNPNASKFA QKIGGSERCP
       130        140        150        160
RCSQAVYAAE KVIGAGKSWH KACFRCAKCG KGLESTTLAD
       170        180        190
KDGEIYCKGC YAKNFGPKGF GFGQGAGALV HSE

A8K268
                                    (SEQ ID NO: 1119)
        10         20         30         40
MPNWGGGKKC GVCQKTVYFA EEVQCEGNSF HKSCFLCMVC
        50         60         70         80
KKNLDSTTVA VHGEEIYCKS CYGKKYGPKG YGYGQGAGTL
        90        100        110        120
STDKGESLGI KHEEAPGHRP TTNPNASKFA QKIGGSERCP
       130        140        150        160
RCSQAVYAAE KVIGAGKSWH KACFRCAKCG KGLESTTLAD
       170        180        190
KDGEIYCKGC YAKNFGPKGF GFGQGAGALV HSE

B4DY28
                                    (SEQ ID NO: 1120)
        10         20         30         40
MPNWGGGKKC GVCQKTVYFA EEVQCEGNSF HKSCFLCMVC
        50         60         70         80
KKNLDSTTVA VHGEEIYCKS CYGKKYGPKG YGYGQGAGTL
        90        100        110        120
STDKGESLGI KHEEAPGHRP TTNPNASKFA QKIGGSERCP
       130        140        150        160
RCSQAVYAAE KSWHKACFRC AKCGKGLEST TLADKDGEIY
       170        180
CKGCYAKNFG PKGFGFGQGA GALVHSE

B4E2T4
                                    (SEQ ID NO: 1121)
        10         20         30         40
MPNWGGGKKC GVCQKTVYFA EEVQCEGNSF HKSCFLCMVC
        50         60         70         80
KKNLDSTTVA VHGEEIYCKS CYGKKYGPKG YGYGQGAGTL
        90        100        110        120
STDKGESLGI KHEEAPGHRP TTNPNASKFA QKIGGSERCP
       130        140
RCSQAVYAAE KVIGAGKGLF

Q59EQ5
                                    (SEQ ID NO: 1122)
        10         20         30         40
PNWGGGKKCG VCQKTVYFAE EVQCEGNSFH KSCFLCMVCK
        50         60         70         80
KNLDSTTVAV HGEEIYCKSC YGKKYGPKGY GYGQGAGTLS
        90        100        110        120
TDKGESLGIK HEEAPGHRPT TNPNASKFAQ KIGGSERCPR
       130        140        150
CSQAVYAAEK VIGAGKVRWL LGMRGMGGDI FLKCGFQNF

Q5U0J2
                                    (SEQ ID NO: 1123)
        10         20         30         40
MPNWGGGKKC GVCQKTVYFA EEVQCEGNSF HKSCFLCMVC
        50         60         70         80
KKNLDSTTVA VHGEEIYCKS CYGKKYGPKG YGYGQGAGTL
        90        100        110        120
STDKGESLGI KHEEAPGHRP TTNPNASKFA QKIGGSERCP
       130        140        150        160
RCSQAVYAAE KVIGAGKSWH KACFRCAKCG KGLESTTLAD
```

```
                 170         180         190
KDGEIYCKGC YAKNFGPKGF GFGQGAGALV HSE

Q6ZMS3
                                  (SEQ ID NO: 1124)
        10         20         30         40
MYAKRPESFS CKKLAMSKKV TPASTQCVRF PFPSTVVCKK 50         60         70         80
NLDSTTVAVH GEEIYCKSCY GKKYGPKGYG YGQGAGTLST 90        100        110        120
DKGESLGIKH EEAPGHRPTT NPNASKFAQK IGGSERCPRC 130        140        150        160
SQAVYAAEKV IGAGKSWHKA CFRCAKCGKG LESTTLADKD 170        180        190
GEIYCKGCYA KNFGPKGFGF GQGAGALVHS E

Q9BTA4
                                  (SEQ ID NO: 1125)
        10         20         30         40
EGNSFHKSCF LCMVCKKNLD STTVAVHGEE IYCKSCYGKK 50         60         70         80
YGPKGYGYGQ GAGTLSTDKG ESLGIKHEEA PGHRPTTNPN 90        100        110        120
ASKFAQKIGG SERCPRCSQA VYAAEKVIGA GKSWHKACFR 130        140        150        160
CAKCGKGLES TTLADKDGEI YCKGCYAKNF GPKGFGFGQG

AGALVHSE
```

Isoform 2 of Transmembrane Protease Serine 4 (TMPRSS4)

```
Q9NRS4-2
                                  (SEQ ID NO: 1126)
        10         20         30         40
MLQDPDSDQP LNSLDVKPLR KPRIPMETFR KVGIPIIIAL 50         60         70         80
LSLASIIIVV VLIKVILDKY YFLCGQPLHF IPRKQLCDGE 90        100        110        120
LDCPLGEDEE HCVKSFPEGP AVAVRLSKDR STLQVLDSAT 130        140        150        160
GNWFSACFDN FTEALAETAC RQMGYSRAVE IGPDQDLDVV 170        180        190        200
EITENSQELR MRNSSGPCLS GSLVSLHCLA CGKSLKTPRV 210        220        230        240
VGVEEASVDS WPWQVSIQYD KQHVCGGSIL DPHWVLTAAH 250        260        270        280
CFRKHTDVFN WKVRAGSDKL GSFPSLAVAK IIIIEFNPMY 290        300        310        320
PKDNDIALMK LQFPLTFSGT VRPICLPFFD EELTPATPLW 330        340        350        360
IIGWGFTKQN GGKMSDILLQ ASVQVIDSTR CNADDAYQGE 370        380        390        400
VTEKMMCAGI PEGGVDTCQG DSGGPLMYQS DQWHVVGIVS 410        420        430
WGYGCGGPST PGVYTKVSAY LNWIYNVWKA EL

Q9NRS4-3
                                  (SEQ ID NO: 1127)
        10         20         30         40
MDPDSDQPLN SLDVKPLRKP RIPMETFRKV GIPIIIALLS 50         60         70         80
LASIIIVVVL IKVILDKYYF LCGQPLHFIP RKQLCDGELD 90        100        110        120
CPLGEDEEHC VKSFPEGPAV AVRLSKDRST LQVLDSATGN 130        140        150        160
WFSACFDNFT EALAETACRQ MGYSSKPTFR AVEIGPDQDL 170        180        190        200
DVVEITENSQ ELRMRNSSGP CLSGSLVSLH CLACGKSLKT 210        220        230        240
PRVVGVEEAS VDSWPWQVSI QYDKQHVCGG SILDPHWVLT 250        260        270        280
AAHCFRKHTD VFNWKVRAGS DKLGSFPSLA VAKIIIIEFN 290        300        310        320
PMYPKDNDIA LMKLQFPLTF SGTVRPICLP FFDEELTPAT 330        340        350        360
PLWIIGWGFT KQNGGKMSDI LLQASVQVID STRCNADDAY 370        380        390        400
QGEVTEKMMC AGIPEGGVDT CQGDSGGPLM YQSDQWHVVG 410        420        430
IVSWGYGCGG PSTPGVYTKV SAYLNWIYNV WKAEL

Q9NRS4
                                  (SEQ ID NO: 1128)
        10         20         30         40
MLQDPDSDQP LNSLDVKPLR KPRIPMETFR KVGIPIIIAL 50         60         70         80
LSLASIIIVV VLIKVILDKY YFLCGQPLHF IPRKQLCDGE 90        100        110        120
LDCPLGEDEE HCVKSFPEGP AVAVRLSKDR STLQVLDSAT 130        140        150        160
GNWFSACFDN FTEALAETAC RQMGYSSKPT FRAVEIGPDQ 170        180        190        200
DLDVVEITEN SQELRMRNSS GPCLSGSLVS LHCLACGKSL 210        220        230        240
KTPRVVGVEE ASVDSWPWQV SIQYDKQHVC GGSILDPHWV 250        260        270        280
LTAAHCFRKH TDVFNWKVRA GSDKLGSFPS LAVAKIIIIE 290        300        310        320
FNPMYPKDND IALMKLQFPL TFSGTVRPIC LPFFDEELTP 330        340        350        360
ATPLWIIGWG FTKQNGGKMS DILLQASVQV IDSTRCNADD 370        380        390        400
AYQGEVTEKM MCAGIPEGGV DTCQGDSGGP LMYQSDWHV 410        420        430
VGIVSWGYGC GGPSTPGVYT KVSAYLNWIY NVWKAEL

A8K2U6
                                  (SEQ ID NO: 1129)
        10         20         30         40
MDPDSDQPLN SLDVKPLRKP RIPMETFRKV GIPIIIALLS 50         60         70         80
LASIIIVVVL IKVILDKYYF LCGQPLHFIP RKQLCDGELD 90        100        110        120
CPLGEDEEHC VKSFPEGPAV AVRLSKDRST LQVLDSATGN 130        140        150        160
WFSACFDNFT EALAETACRQ MGYSSKPTFR AVEIGPDQDL 170        180        190        200
DVVEITENSQ ELRMRNSSGP CLSGSLVSLH CLACGKSLKT
```

```
                210         220         230         240
        PRVVGGEEAS  VDSWPWQVSI  QYDKQHVCGG  SILDPHWVLT 250         260         270         280
        AAHCFRKHTD  VFNWKVRAGS  DKLGSFPSLA  VAKIIIIEFN 290         300         310         320
        PMYPKNDIA  LMKLQFPLTF  SGTVRPICLP  FFDEELTPAT

330
        PLWIIGWGFT  KQNGG

B7Z8X1
                                        (SEQ ID NO: 1130)
                 10          20          30          40
        MDPDSDQPLN  SLDVKPLRKP  RIPMETFRKV  GIPIIIALLS 50          60          70          80
        LASIIIVVVL  IKVILDKYYF  LCGQPLHFIP  RKQLCDGELD 90         100         110         120
        CPLGEDEEHC  VKSFPEGPAV  AVRLSKDRST  LQVLDSATGN 130         140         150         160
        WFSACFDNFT  EALAETACRQ  MGYSSKPTFR  AVEIGPDQDL 170         180         190         200
        DVVEITENSQ  ELRMRNSSGP  CLSGSLVSLH  CLACGKSLKT 210         220         230         240
        PRVVGVEEAS  VDSWPWQVSI  QYDKQHVCGG  SILDPHWVLT 250         260         270         280
        PAHCFRKHTD  VFNWKVRAGS  NKLGSFPSLA  VAKIIIIEFN 290         300         310         320
        PMYPKNDIA  LMKLQFPLTF  SGTVRPICLP  FFDEELTPAT 330         340         350         360
        PLWIIGWGFT  KQNGGKMSDI  LLQASVQVID  STRCNADDAY 370         380         390         400
        QGEVTEKMMC  AGIPEGGVDT  CQGDSGGPLM  YQSDQWHVVG 410         420         430
        IVSWGYGCGG  PSTPGVYTKV  SAYLNWIYNV  WKAEL

B7Z900
                                        (SEQ ID NO: 1131)
                 10          20          30          40
        METFRKVGIP  IIIALLSLAS  IIIVVVLIKV  ILDKYYFLCG 50          60          70          80
        QPLHFIPRKQ  LCDGELDCPL  GEDEEHCVKS  FPEGPAVAVR 90         100         110         120
        LSKDRSTLQV  LDSATGNWFS  ACFDNFTEAL  AETACRQMGY 130         140         150         160
        SSKPTFRAVE  IGPDQDLDVV  EITENSQELR  MRNSSGPCLS 170         180         190         200
        GSLVSLHCLA  CGKSLKTPRV  VGGEEASVDS  WPWQVSIQYD 210         220         230         240
        KQHVCGGSIL  DPHWVLTAAH  CFRKHTDVFN  WKVRAGSDKL 250         260         270         280
        GSFPSLAVAK  IIIIEFNPMY  PKDNDIALMK  LQFPLTFSGT 290         300         310         320
        VRPICLPFFD  EELTPATPLW  IIGWGFTKQN  GGKMSDILLQ 330         340         350         360
        ASVQVIDSTR  CNADDAYQGE  VTEKMMCAGI  PEGGVDTCQG 370         380         390         400
        DSGGPLMYQS  DQWHVVGIVS  WGYGCGGPST  PGVYTKVSAY

410
        LNWIYNVWKA  EL

Transgelin-2 (TAGLN2)

P37802
                                        (SEQ ID NO: 1132)
                 10          20          30          40
        MANRGPAYGL  SREVQQKIEK  QYDADLEQIL  IQWITTQCRK 50          60          70          80
        DVGRPQPGRE  NFQNWLKDGT  VLCELINALY  PEGQAPVKKI 90         100         110         120
        QASTMAFKQM  EQISQFLQAA  ERYGINTTDI  FQTVDLWEGK 130         140         150         160
        NMACVQRTLM  NLGGLAVARD  DGLFSGDPNW  FPKKSKENPR 170         180         190
        NFSDNQLQEG  KNVIGLQMGT  NRGASQAGMT  GYGMPRQIL

Profilin-1 (PFN1)

P07737
                                        (SEQ ID NO: 1133)
                 10          20          30          40
        MAGWNAYIDN  LMADGTCQDA  AIVGYKDSPS  VWAAVPGKTF 50          60          70          80
        VNITPAEVGV  LVGKDRSSFY  VNGLTLGGQK  CSVIRDSLLQ 90         100         110         120
        DGEFSMDLRT  KSTGGAPTFN  VTVTKTDKTL  VLLMGKEGVH 130         140
        GGLINKKCYE  MASHLRRSQY

Q53Y44
                                        (SEQ ID NO: 1134)
                 10          20          30          40
        MAGWNAYIDN  LMADGTCQDA  AIVGYKDSPS  VWAAVPGKTF 50          60          70          80
        VNITPAEVGV  LVGKDRSSFY  VNGLTLGGQK  CSVIRDSLLQ 90         100         110         120
        DGEFSMDLRT  KSTGGAPTFN  VTVTKTDKTL  VLLMGKEGVH 130         140
        GGLINKKCYE  MASHLRRSQY

Matrix Metalloproteinase-9 (MMP9)

P14780
                                        (SEQ ID NO: 1135)
                 10          20          30          40
        MSLWQPLVLV  LLVLGCCFAA  PRQRQSTLVL  FPGDLRTNLT 50          60          70          80
        DRQLAEEYLY  RYGYTRVAEM  RGESKSLGPA  LLLLQKQLSL 90         100         110         120
        PETGELDSAT  LKAMRTPRCG  VPDLGRFQTF  EGDLKWHHHN 130         140         150         160
        ITYWIQNYSE  DLPRAVIDDA  FARAFALWSA  VTPLTFTRVY 170         180         190         200
        SRDADIVIQF  GVAEHGDGYP  FDGKDGLLAH  AFPPGPGIQG 210         220         230         240
        DAHFDDDELW  SLGKGVVVPT  RFGNADGAAC  HFPFIFEGRS 250         260         270         280
        YSACTTDGRS  DGLPWCSTTA  NYDTDDRFGF  CPSERLYTQD
```

```
                290        300        310        320
         GNADGKPCQF PFIFQGQSYS ACTTDGRSDG YRWCATTANY 330        340        350        360
         DRDKLFGFCP TRADSTVMGG NSAGELCVFP FTFLGKEYST 370        380        390        400
         CTSEGRGDGR LWCATTSNFD SDKKWGFCPD QGYSLFLVAA 410        420        430        440
         HEFGHALGLD HSSVPEALMY PMYRFTEGPP LHKDDVNGIR 450        460        470        480
         HLYGPRPEPE PRPPTTTTPQ PTAPPTVCPT GPPTVHPSER 490        500        510        520
         PTAGPTGPPS AGPTGPPTAG PSTATTVPLS PVDDACNVNI 530        540        550        560
         FDAIAEIGNQ LYLFKDGKYW RFSEGRGSRP QGPFLIADKW 570        580        590        600
         PALPRKLDSV FEERLSKKLF FFSGRQVWVY TGASVLGPRR 610        620        630        640
         LDKLGLGADV AQVTGALRSG RGKMLLFSGR RLWRFDVKAQ 650        660        670        680
         MVDPRSASEV DRMFPGVPLD THDVFQYREK AYFCQDRFYW 690        700
         RVSSRSELNQ VDQVGYVTYD ILQCPED

B7Z747
                                          (SEQ ID NO: 1136)
                 10         20         30         40
         MSLWQPLVLV LLVLGCCFAA PRQRQSTLVL FPGDLRTNLT 50         60         70         80
         DRQLAEEYLY RYGYTRVAEM RGESKSLGPA LLLLQKQLSL 90        100        110        120
         PETGELDSAT LKAMRTPRCG VPDLGRFQTL EGDLKWHHHN 130        140        150        160
         ITYWIQNYSA CTTDGRSDGL PWCSTTANYD TDDRFGFCPS 170        180        190        200
         ERLYTRDGNA DGKPCQFPFI FQGQSYSACT TDGRSDGYRW 210        220        230        240
         CATTANYDRD KLFGFCPTRA DSTVMGGNSA GELCVFPFTF 250        260        270        280
         LGKEYSTCTS EGRGDGRLWC ATTSNFDSDK KWGFCPDQGY 290        300        310        320
         SLFLVAAHEF GHALGLDHSS VPEALMYPMY RFTEGPPLHK 330        340        350        360
         DDVNGIRHLY GPRPEPEPRP PTTTTPQPTA PPTVCPTGPP 370        380        390        400
         TVHPSERPTA GPTGPPSAGP TGPPTAGPST ATTVPLSPVD 410        420        430        440
         DACNVNIFDA IAEIGNQLYL FKDGKYWRFS EGRGSRPQGP 450        460        470        480
         FLIADKWPAL PRKLDSVFEE PLSKKLFFFS GRQVWVYTGA 490        500        510        520
         SVLGPRRLDK LGLGADVAQV TGALRSGRGK MLLFSGRRLW 530        540        550        560
         RFDVKAQMVD PRSASEVDRM FPGVPLDTHD VFQYREKAYF 570        580        590
         CQDRFYWRVS SRSELNQVDQ VGYVTYDILQ CPED
```

Protein S100-A4 (S100A4)

```
         P26447
                                          (SEQ ID NO: 1137)
                 10         20         30         40
         MACPLEKALD VMVSTFHKYS GKEGDKFKLN KSELKELLTR 50         60         70         80
         ELPSFLGKRT DEAAFQKLMS NLDSNRDNEV DFQEYCVFLS 90        100
         CIAMMCNEFF EGFPDKQPRK K

D3DV46
                                          (SEQ ID NO: 1138)
                 10         20         30         40
         MACPLEKALD VMVSTFHKYS GKEGDKFKLN KSELKELLTR 50         60         70         80
         ELPSFLGKRT DEAAFQKLMS NLDSNRDNEV DFQEYCVFLS 90        100
         CIAMMCNEFF EGFPDKQPRK K
```

Histone H1.5 (HIST1H1B)

```
         P16401
                                          (SEQ ID NO: 1139)
                 10         20         30         40
         MSETAPAETA TPAPVEKSPA KKKATKKAAG AGAAKRKATG 50         60         70         80
         PPVSELITKA VAASKERNGL SLAALKKALA AGGYDVEKNN 90        100        110        120
         SRIKLGLKSL VSKGTLVQTK GTGASGSFKL NKKAASGEAK 130        140        150        160
         PKAKKAGAAK AKKPAGATPK KAKKAAGAKK AVKKTPKKAK 170        180        190        200
         KPAAAGVKKV AKSPKKAKAA AKPKKATKSP AKPKAVKPKA 210        220
         AKPKAAKPKA AKPKAAKAKK AAAKKK
```

Properdin (CFP)

```
         P27918
                                          (SEQ ID NO: 1140)
                 10         20         30         40
         MITEGAQAPR LLLPPLLLLL TLPATGSDPV LCFTQYEESS 50         60         70         80
         GKCKGLLGGG VSVEDCCLNT AFAYQKRSGG LCQPCRSPRW 90        100        110        120
         SLWSTWAPCS VTCSEGSQLR YRRCVGWNGQ CSGKVAPGTL 130        140        150        160
         EWQLQACEDQ QCCPEMGGWS GWGPWEPCSV TCSKGTRTRR 170        180        190        200
         RACNHPAPKC GGHCPGQAQE SEACDTQQVC PTHGAWATWG 210        220        230        240
         PWTPCSASCH GGPHEPKETR SRKCSAPEPS QKPPGKPCPG 250        260        270        280
         LAYEQRRCTG LPPCPVAGGW GPWGPVSPCP VTCGLGQTME 290        300        310        320
         QRTCNHPVPQ HGGPFCAGDA TRTHICNTAV PCPVDGEWDS 330        340        350        360
         WGEWSPCIRR NMKSISCQEI PGQQSRGRTC RGRKFDGHRC
```

```
                                -continued
                370         380         390         400
         AGQQQDIRHC  YSIQHCPLKG  SWSEWSTWGL  CMPPCGPNPT 410         420         430         440
         RARQRLCTPL  LPKYPPTVSM  VEGQGEKNVT  FWGRPLPRCE 450         460
         ELQGQKLVVE  EKRPCLHVPA  CKDPEEEEL
```

Vasodilator-Simulated Phosphoprotein (VASP)

```
         P50552
                                          (SEQ ID NO: 1141)
                10          20          30          40
         MSETVICSSR  ATVMLYDDGN  KRWLPAGTGP  QAFSRVQIYH 50          60          70          80
         NPTANSFRVV  GRKMQPDQQV  VINCAIVRGV  KYNQATPNFH 90         100         110         120
         QWRDARQVWG  LNFGSKEDAA  QFAAGMASAL  EALEGGGPPP 130         140         150         160
         PPALPTWSVP  NGPSPEEVEQ  QKRQQPGPSE  HIERRVSNAG 170         180         190         200
         GPPAPPAGGP  PPPPGPPPPP  GPPPPPGLPP  SGVPAAAHGA 210         220         230         240
         GGGPPPAPPL  PAAQGPGGGG  AGAPGLAAAI  AGAKLRKVSK 250         260         270         280
         QEEASGGPTA  PKAESGRSGG  GGLMEEMNAM  LARRRKATQV 290         300         310         320
         GEKTPKDESA  NQEEPEARVP  AQSESVRRPW  EKNSTTLPRM 330         340         350         360
         KSSSSVTTSE  TQPCTPSSSD  YSDLQRVKQE  LLEEVKKELQ 370         380
         KVKEEIIEAF  VQELRKRGSP
```

Myosin-7 (MYH7)

```
         P12883
                                          (SEQ ID NO: 1142)
                10          20          30          40
         MGDSEMAVFG  AAAPYLRKSE  KERLEAQTRP  FDLKKDVFVP 50          60          70          80
         DDKQEFVKAK  IVSREGGKVT  AETEYGKTVT  VKEDQVMQQN 90         100         110         120
         PPKFDKIEDM  AMLTFLHEPA  VLYNLKDRYG  SWMIYTYSGL 130         140         150         160
         FCVTVNPYKW  LPVYTPEVVA  AYRGKKRSEA  PPHIFSISDN 170         180         190         200
         AYQYMLTDRE  NQSILITGES  GAGKTVNTKR  VIQYFAVIAA 210         220         230         240
         IGDRSKKDQS  PGKGTLEDQI  IQANPALEAF  GNAKTVRNDN 250         260         270         280
         SSRFGKFIRI  HFGATGKLAS  ADIETYLLEK  SRVIFQLKAE 290         300         310         320
         RDYHIFYQIL  SNKKPELLDM  LLITNNPYDY  AFISQGETTV 330         340         350         360
         ASIDDAEELM  ATDNAFDVLG  FTSEEKNSMY  KLTGAIMHFG 370         380         390         400
         NMKFKLKQRE  EQAEPDGTEE  ADKSAYLMGL  NSADLLKGLC 410         420         430         440
         HPRVKVGNEY  VTKGQNVQQV  IYATGALAKA  VYERMFNWMV 450         460         470         480
         TRINATLETK  QPRQYFIGVL  DIAGFEIFDF  NSFEQLCINF 490         500         510         520
         TNEKLQQFFN  HHMFVLEQEE  YKKEGIEWTF  IDFGMDLQAC 530         540         550         560
         IDLIEKPMGI  MSILEEECMF  PKATDMTFKA  KLFDNHLGKS 570         580         590         600
         ANFQKPRNIK  GKPEAHFSLI  HYAGIVDYNI  IGWLQKNKDP 610         620         630         640
         LNETVVGLYQ  KSSLKLLSTL  FANYAGADAP  IEKGKGKAKK 650         660         670         680
         GSSFQTVSAL  HRENLNKLMT  NLRSTHPHFV  RCIIPNETKS 690         700         710         720
         PGVMDNPLVM  HQLRCNGVLE  GIRICRKGFP  NRILYGDFRQ 730         740         750         760
         RYRILNPAAI  PEGQFIDSRK  GAEKLLSSLD  IDHNQYKFGH 770         780         890         800
         TKVFFKAGLL  GLLEEMRDER  LSRIITRIQA  QSRGVLARME 810         820         830         840
         YKKLLERRDS  LLVIQWNIRA  FMGVKNWPWM  KLYFKIKPLL 850         860         870         880
         KSAEREKEMA  SMKEEFTRLK  EALEKSEARR  KELEEKMVSL 890         900         910         920
         LQEKNDLQLQ  VQAEQDNLAD  AEERCDQLIK  NKIQLEAKVK 930         940         950         960
         EMNERLEDEE  EMNAELTAKK  RKLEDECSEL  KRDIDDLELT 970         980         990        1000
         LAKVEKEKHA  TENKVKNLTE  EMAGLDEIIA  KLTKEKKALQ 1010        1020        1030        1040
         EAHQQALDDL  QAEEDKVNTL  TKAKVKLEQQ  VDDLEGSLEQ 1050        1060        1070        1080
         EKKVRMDLER  AKRKLEGDLK  LTQESIMDLE  NDKQQLDERL 1090        1100        1110        1120
         KKKDFELNAL  NARIEDEQAL  GSQLQKKLKE  LQARIEELEE 1130        1140        1150        1160
         ELEAERTARA  KVEKLRSDLS  RELEEISERL  EKAGGATSVQ 1170        1180        1190        1200
         IEMNKKREAE  FQKMRRDLEE  ATLQHEATAA  ALRKKHADSV 1210        1220        1230        1240
         AELGEQIDNL  QRVKQKLEKE  KSEFKLELDD  VTSNMEQIIK 1250        1260        1270        1280
         AKANLEKMCR  TLEDQMNEHR  SKAEETQRSV  NDLTSQRAKL 1290        1300        1310        1320
         QTENGELSRQ  LDEKEALISQ  LTRGKLTYTQ  QLEDKRQLE 1330        1340        1350        1360
         EEVKAKNALA  HALQSARHDC  DLLREQYEEE  TEAKAELQRV 1370        1380        1390        1400
         LSKANSEVAQ  WRTKYETDAI  QRTEELEEAK  KKLAQRLQEA 1410        1420        1430        1440
         EEAVEAVNAK  CSSLEKTKHR  LQNEIEDLMV  DVERSNAAAA 1450        1460        1470        1480
         ALDKKQRNFD  KILAEWKQKY  EESQSELESS  QKEARSLSTE 1490        1500        1510        1520
```

-continued

```
         1530        1540        1550        1560
LFKLKNAYEE SLEHLETFKR ENKNLQEEIS DLTEQLGSSG 1530        1540        1550        1560
KTIHELEKVR KQLEAEKMEL QSALEEAEAS LEHEEGKILR 1570        1580        1590        1600
AQLEFNQIKA EIERKLAEKD EEMEQAKRNH LRVVDSLQTS 1610        1620        1630        1640
LDAETRSRNE ALRVKKKMEG DLNEMEIQLS HANRMAAEAQ 1650        1660        1670        1680
KQVKSLQSLL KDTQIQLDDA VRANDDLKEN IAIVERRNNL 1690        1700        1710        1720
LQAELEELRA VVEQTERSRK LAEQELIETS ERVQLLHSQN 1730        1740        1750        1760
TSLINQKKKM DADLSQLQTE VEEAVQECRN AEEKAKKAIT 1770        1780        1790        1800
DAAMMAEELK KEQDTSAHLE RMKKNMEQTI KDLQHRLDEA 1810        1820        1830        1840
EQIALKGGKK QLQKLEARVR ELENELEAEQ KRNAESVKGM 1850        1860        1870        1880
RKSERRIKEL TYQTEEDRKN LLRLQDLVDK LQLKVKAYKR 1890        1900        1910        1920
QAEEAEEQAN TNLSKFRKVQ HELDEAEERA DIAESQVNKL

1930
RAKSRDIGTK GLNEE
```

Myosin-6 (MYH6)

```
P13533                                 (SEQ ID NO: 1143)
           10         20         30         40
MTDAQMADFG AAAQYLRKSE KERLEAQTRP FDIRTECFVP 50         60         70         80
DDKEEFVKAK ILSREGGKVI AETENGKTVT VKEDQVLQQN 90        100        110        120
PPKFDKIEDM AMLTFLHEPA VLFNLKERYA AWMIYTYSGL 130        140        150        160
FCVTVNPYKW LPVYNAEVVA AYRGKKRSEA PPHIFSISDN 170        180        190        200
AYQYMLTDRE NQSILITGES GAGKTVNTKR VIQYFASIAA 210        220        230        240
IGDRGKKDNA NANKGTLEDQ IIQANPALEA FGNAKTVRND 250        260        270        280
NSSRFGKFIR IHFGATGKLA SADIETYLLE KSRVIFQLKA 290        300        310        320
ERNYHIFYQI LSNKKPELLD MLLVTNNPYD YAFVSQGEVS 330        340        350        360
VASIDDSEEL MATDSAFDVL GFTSEEKAGV YKLTGAIMHY 370        380        390        400
GNMKFKQKQR EEQAEPDGTE DADKSAYLMG LNSADLLKGL 410        420        430        440
CHPRVKVGNE YVTKGQSVQQ VYYSIGALAK AVYEKMFNWM 450        460        470        480
VTRINATLET KQPRQYFIGV LDIAGFEIFD FNSFEQLCIN 490        500        510        520
FTNEKLQQFF NHHMFVLEQE EYKKEGIEWT FIDFGMDLQA 530        540        550        560
```

```
          570        580        590        600
CIDLIEKPMG IMSILEEECM FPKATDMTFK AKLYDNHLGK 570        580        590        600
SNNFQKPRNI KGKQEAHFSL IHYAGTVDYN ILGWLEKNKD 610        620        630        640
PLNETVVALY QKSSLKLMAT LFSSYATADT GDSGKSKGGK 650        660        670        680
KKGSSFQTVS ALHRENLNKL MTNLRTTHPH FVRCIIPNER 690        700        710        720
KAPGVMDNPL VMHQLRCNGV LEGIRICRKG FPNRILYGDF 730        740        750        760
RQRYRILNPV AIPEGQFIDS RKGTEKLLSS LDIDHNQYKF 770        780        790        800
GHTKVFFKAG LLGLLEEMRD ERLSRIITRM QAQARGQLMR 810        820        830        840
IEFKKIVERR DALLVIQWNI RAFMGVKNWP WMKLYFKIKP 850        860        870        880
LLKSAETEKE MATMKEEFGR IKETLEKSEA RRKELEEKMV 890        900        910        920
SLLQEKNDLQ LQVQAEQDNL NDAEERCDQL IKNKIQLEAK 930        940        950        960
VKEMNERLED EEEMNAELTA KKRKLEDECS ELKKDIDDLE 970        980        990       1000
LTLAKVEKEK HATENKVKNL TEEMAGLDEI IAKLTKEKKA 1010       1020       1030       1040
LQEAHQQALD DLQVEEDKVN SLSKSKVKLE QQVDDLEGSL 1050       1060       1070       1080
EQEKKVRMDL ERAKRKLEGD LKLTQESIMD LENDKLQLEE 1090       1100       1110       1120
KLKKKEFDIN QQNSKIEDEQ VLALQLQKKL KENQARIEEL 1130       1140       1150       1160
EEELEAERTA RAKVEKLRSD LSRELEEISE RLEEAGGATS 1170       1180       1190       1200
VQIEMNKKRE AEFQKMRRDL EEATLQHEAT AAALRKKHAD 1210       1220       1230       1240
SVAELGEQID NLQRVKQKLE KEKSEFKLEL DDVTSNMEQI 1250       1260       1270       1280
IKAKANLEKV SRTLEDQANE YRVKLEEAQR SLNDFTTQRA 1290       1300       1310       1320
KLQTENGELA RQLEEKEALI SQLTRGKLSY TQQMEDLKRQ 1330       1340       1350       1360
LEEEGKAKNA LAHALQSARH DCDLLREQYE EETEAKAELQ 1370       1380       1390       1400
RVLSKANSEV AQWRTKYETD AIQRTEELEE AKKKLAQRLQ 1410       1420       1430       1440
DAEEAVEAVN AKCSSLEKTK HRLQNEIEDL MVDVERSNAA 1450       1460       1470       1480
AAALDKKQRN FDKILAEWKQ KYEESQSELE SSQKEARSLS 1490       1500       1510       1520
TELFKLKNAY EESLEHLETF KRENKNLQEE ISDLTEQLGE 1530       1540       1550       1560
GGKNVHELEK VRKQLEVEKL ELQSALEEAE ASLEHEEGKI 1570       1580       1590       1600
LRAQLEFNQI KAEIERKLAE KDEEMEQAKR NHQRVVDSLQ 1610       1620       1630       1640
```

-continued

```
           TSLDAETRSR NEVLRVKKKM EGDLNEMEIQ LSHANRMAAE
      1650       1660       1670       1680
AQKQVKSLQS LLKDTQIQLD DAVRANDDLK ENIAIVERRN
      1690       1700       1710       1720
NLLQAELEEL RAVVEQTERS RKLAEQELIE TSERVQLLHS
      1730       1740       1750       1760
QNTSLINQKK KMESDLTQLQ SEVEEAVQEC RNAEEKAKKA
      1770       1780       1790       1800
ITDAAMMAEE LKKEQDTSAH LERMKKNMEQ TIKDLQHRLD
      1810       1820       1830       1840
EAEQIALKGG KKQLQKLEAR VRELEGELEA EQKRNAESVK
      1850       1860       1870       1880
GMRKSERRIK ELTYQTEEDK KNLLRLQDLV DKLQLKVKAY
      1890       1900       1910       1920
KRQAEEAEEQ ANTNLSKFRK VQHELDEAEE RADIAESQVN
      1930
KLRAKSRDIG AKQKMHDEE

D9YZU2
                             (SEQ ID NO: 1144)
        10         20         30         40
MTDAQMADFG AAAQYLRKSE KERLEAQTRP FDIRTECFVP
        50         60         70         80
DDKEEFVKAK ILSREGGKVI AETENGKTVT VKEDQVLQQN
        90        100        110        120
PPKFDKIEDM AMLTFLHEPA VLFNLKERYA AWMIYTYSGL
       130        140        150        160
FCVTVNPYKW LPVYNAEVVA AYRGKKRSEA PPHIFSISDN
       170        180        190        200
AYQYMLTDRE NQSILITGES GAGKTVNTKR VIQYFASIAA
       210        220        230        240
IGDRGKKDNA NANKGTLEDQ IIQANPALEA FGNAKTVRND
       250        260        270        280
NSSRFGKFIR IHFGATGKLA SADIETYLLE KSRVIFQLKA
       290        300        310        320
ERNYHIFYQI LSNKKPELLD MLLVTNNPYD YAFVSQGEVS
       330        340        350        360
VASIDDSEEL MATDSAFDVL GFTSEEKAGV YKLTGAIMHY
       370        380        390        400
GNMKFKQKQR EEQAEPDGTE DADKSAYLMG LNSADLLKGL
       410        420        430        440
CHPRVKVGNE YVTKGQSVQQ VYYSIGALAK AVYEKMFNWM
       450        460        470        480
VTRINATLET KQPRQYFIGV LDIAGFEIFD FNSFEQLCIN
       490        500        510        520
FTNEKLQQFF NHHMFVLEQE EYKKEGIEWT FIDFGMDLQA
       530        540        550        560
CIDLIEKPMG IMSILEEECM FPKATDMTFK AKLYDNHLGK
       570        580        590        600
SNNFQKPRNI KGKQEAHFSL IHYAGTVDYN ILGWLEKNKD
       610        620        630        640
PLNETVVALY QKSSLKLMAT LFSSYATADT GDSGKSKGGK
       650        660        670        680
KKGSSFQTVS ALHRENLNKL MTNLRTTHPH FVRCIIPNER
       690        700        710        720
KAPGVMDNPL VMHQLRCNGV LEGIRICRKG FPNRILYGDF
       730        740        750        760
RQRYRILNPV AIPEGQFIDS RKGTEKLLSS LDIDHNQYKF
       770        780        790        800
GHTKVFFKAG LLGLLEEMRD ERLSRIITRM QAQARGQLMR
       810        820        830        840
IEFKKIVERR DALLVIQWNI RAFMGVKNWP WMKLYFKIKP
       850        860        870        880
LLKSAETEKE MATMKEEFGR IKETLEKSEA RRKELEEKMV
       890        900        910        920
SLLQEKNDLQ LQVQAEQDNL NDAEERCDQL IKNKIQLEAK
       930        940        950        960
VKEMNERLED EEEMNAELTA KKRKLEDECS ELKKDIDDLE
       970        980        990       1000
LTLAKVEKEK HATENKVKNL TEEMAGLDEI IAKLTKEKKA
      1010       1020       1030       1040
LQEAHQQALD DLQVEEDKVN SLSKSKVKLE QQVDDLEGSL
      1050       1060       1070       1080
EQEKKVRMDL ERAKRKLEGD LKLTQESIMD LENDKLQLEE
      1090       1100       1110       1120
KLKKKEFDIN QQNSKIEDEQ VLALQLQKKL KENQARIEEL
      1130       1140       1150       1160
EEELEAERTA RAKVEKLRSD LSRELEEISE RLEEAGGATS
      1170       1180       1190       1200
VQIEMNKKRE AEFQKMRRDL EEATLQHEAT AAALRKKHAD
      1210       1220       1230       1240
SVAELGEQID NLQRVKQKLE KEKSEFKLEL DDVTSNMEQI
      1250       1260       1270       1280
IKAKANLEKV SRTLEDQANE YRVKLEEAQR SLNDFTTQRA
      1290       1300       1310       1320
KLQTENGELA RQLEEKEALI SQLTRGKLSY TQQMEDLKRQ
      1330       1340       1350       1360
LEEEGKAKNA LAHALQSARH DCDLLREQYE EETEAKAELQ
      13701380        1390       1400
RVLSKANSEV AQWRTKYETD AIQRTEELEE AKKKLAQRLQ
      1410       1420       1430       1440
DAEEAVEAVN AKCSSLEKTK HRLQNEIEDL MVDVERSNAA
      1450       1460       1470       1480
AAALDKKQRN FDKILAEWKQ KYEESQSELE SSQKEARSLS
      1490       1500       1510       1520
TELFKLKNAY EESLEHLETF KRENKNLQEE ISDLTEQLGE
      1530       1540       1550       1560
GGKNVHELEK VRKQLEVEKL ELQSALEEAE ASLEHEEGKI
      1570       1580       1590       1600
LRAQLEFNQI KAEIERKLAE KDEEMEQAKR NHQRVVDSLQ
      1610       1620       1630       1640
TSLDAETRSR NEVLRVKKKM EGDLNEMEIQ LSHANRMAAE
      1650       1660       1670       1680
AQKQVKSLQS LLKDTQIQLD DAVRANDDLK ENIAIVERRN
      1690       1700       1710       1720
NLLQAELEEL RAVVEQTERS RKLAEQELIE TSERVQLLHS
      1730       1740       1750       1760
QNTSLINQKK KMESDLTQLQ SEVEEAVQEC RNAEEKAKKA
      1770       1780       1790       1800
ITDAAMMAEE LKKEQDTSAH LERMKKNMEQ TIKDLQHRLD
```

-continued

```
      1810       1820       1830       1840
EAEQIALKGG KKQLQKLEAR VRELEGELEA EQKRNAESVK 1850       1860       1870       1880
GMRKSERRIK ELTYQTEEDK KNLLRLQDLV DKLQLKVKAY
```

```
      1890       1990       1910       1920
KRQAEEAEEQ ANTNLSKFRK VQHELDEAEE RADIAESQVN

1930
KLRAKSRDIG AKQKMHDEE
```

MHC Class I Antigen (Fragment)(HLA-A)

```
D7NNN8
                                         (SEQ ID NO: 1145)
      10         20         30         40         50
SHSMRYFYTS VSRPGRGEPR FIAVGYVDDT QFVRFDSDAA SQRMEPRAPW 60         70         80         90        100
IEQEGPEYWD RNTRNVKAQS QTDRVDLETL RGYYNQSEAG SHTIQMMYGC 110        120        130        140        150
DVGSDGRFLR GYRQDAYDGK DYIALKEDLR SWTAADMAAQ TTKHKWEAAH 160        170        180
VAEQWRAYLE GTCVEWLRRY LENGKETLQR T

D7NNP3
                                         (SEQ ID NO: 1146)
      10         20         30         40         50
SHSMRYFYTS VSRPGRGEPR FIAVGYVDDT QFVRFDSDAA SQRMEPRAPW 60         70         80         90        100
IEQEGPEYWD RNTRNVKAQS QTDRVDLETL RGYYNQSEAG SHTIQMMYGC 110        120        130        140        150
DVGSDGRFLR GYRQDAYDGK DYIALKEDLR SWTAADMAAQ TTKHKWEAAH 160        170        180
VAEQWRAYLE GTCVEWLRRY LENGKETLQR T

Q05G04
                                         (SEQ ID NO: 1147)
      10         20         30         40         50
SHSMRYFYTS VSRPGRGEPR FIAVGYVDDT QFVRFDSDAA SQRMEPRAPW 60         70         80         90        100
IEQEGPEYWD RNTRNVKAQS QTDRVDLETL RGYYNQSEAG SHTIQMMYGC 110        120        130        140        150
DVGSDGRFLR GYRQDAYDGK DYIALKEDLR SWTAADMAAQ TTKHKWEAAH 160        170        180
VAEQWRAYLE GTCVEWLRRY LENGKETLQR T
```

CD5 Antigen-Like (CD5)

```
O43866
                                         (SEQ ID NO: 1148)
      10         20         30         40         50
MALLFSLILA ICTRPGFLAS PSGVRLVGGL HRCEGRVEVE QKGQWGTVCD 60         70         80         90        100
DGWDIKDVAV LCRELGCGAA SGTPSGILYE PPAEKEQKVL IQSVSCTGTE 110        120        130        140        150
DTLAQCEQEE VYDCSHDEDA GASCENPESS FSPVPEGVRL ADGPGHCKGR 160        170        180        190        200
VEVKHQNQWY TVCQTGWSLR AAKVVCRQLG CGRAVLTQKR CNKHAYGRKP 210        220        230        240        250
IWLSQMSCSG REATLQDCPS GPWGKNTCNH DEDTWVECED PFDLRLVGGD 260        270        280        290        300
NLCSGRLEVL HKGVWGSVCD DNWGEKEDQV VCKQLGCGKS LSPSFRDRKC 310        320        330        340
YGPGVGRIWL DNVRCSGEEQ SLEQCQHRFW GFHDCTHQED VAVICSG
```

Cystatin-A (CSTA)

P01040 (SEQ ID NO: 1149)
```
         10         20         30         40         50
MIPGGLSEAK PATPEIQEIV DKVKPQLEEK TNETYGKLEA VQYKTQVVAG 60         70         80         90
TNYYIKVRAG DNKYMHLKVF KSLPGQNEDL VLTGYQVDKN KDDELTGF
```

C9J0E4 (SEQ ID NO: 1150)
```
         10         20         30         40         50
MIPGGLSEAK PATPEIQEIV DKVKPQLEEK TNETYGKLEA VQYKTQVVAG

60
TNYYIKVRVQ HLL
```

Q61B90 (SEQ ID NO: 1151)
```
         10         20         30         40         50
MIPGGLSEAK PATPEIQEIV DKVKPQLEEK TNETYGKLEA VQYKTQVVAG 60         70         80         90
TNYYIKVRAG DNKYMHLKVF KSLPGQNEDL VLTGYQVDKN KDDELTGF
```

Cathepsin L1 (CTSL1)

P07711 (SEQ ID NO: 1152)
```
         10         20         30         40         50
MNPTLILAAF CLGIASATLT FDHSLEAQWT KWKAMHNRLY GMNEEGWRRA 60         70         80         90        100
VWEKNMKMIE LHNQEYREGK HSFTMAMNAF GDMTSEEFRQ VMNGFQNRKP 110        120        130        140        150
RKGKVFQEPL FYEAPRSVDW REKGYVTPVK NQGQCGSCWA FSATGALEGQ 160        170        180        190        200
MFRKTGRLIS LSEQNLVDCS GPQGNEGCNG GLMDYAFQYV QDNGGLDSEE 210        220        230        240        250
SYPYEATEES CKYNPKYSVA NDTGFVDIPK QEKALMKAVA TVGPISVAID 260        270        280        290        300
AGHESFLFYK EGIYFEPDCS SEDMDHGVLV VGYGFESTES DNNKYWLVKN 310        320        330
SWGEEWGMGG YVKMAKDRRN HCGIASAASY PTV
```

A5PLM9 (SEQ ID NO: 1153)
```
         10         20         30         40         50
MNPTLILAAF CLGIASATLT FDHSLEAQWT KWKAMHNRLY GMNEEGWRRA 60         70         80         90        100
VWEKNMKMIE LHNQEYREGK HSFTMAMNAF GDMTSEEFRQ VMNGFQNRKP 110        120        130        140        150
RKGKVFQEPL FYEAPRSVDW REKGYVTPVK NQGPCGSCWA FSATGALEGQ 160        170        180        190        200
MFRKTGRLIS LSEQNLVDCS GPQGNEGCNG GLMDYAFQYV QDNGGLDSEE 210        220        230        240        250
SYPYEATEES CKYNPKYSVA NDTGFVDIPK QEKALMKAVA TVGPISVAID 260        270        280        290        300
AGHESFLFYK EGIYFEPDCS SEDMDHGVLV VGYGFESTES DNNKYWLVKN 310        320        330
SWGEEWGMGG YVKMAKDRRN HCGIASAASY PTV
```

B3LQK4 (SEQ ID NO: 1154)
```
         10         20         30         40         50
MNPTLILAAF CLGIASATLT FDHSLEAQWT KWKAMHNRLY GMNEEGWRRA
```

```
                 60         70         80         90        100
         VWEKNMKMIE LHNQEYREGK HSFTMAMNAF GDMTSEELRQ VMNGFQNRKP 110        120        130        140        150
         RKGKVFQEPL FYEAPRSVDW REKGYVTPVK NQGQCGSCWA FSATGALEGQ 160        170        180        190        200
         MFRKTGRLIS LSEQNLVDCS GPQGNEGCNG GLMDYAFQYV QDNGGLDSEE 210        220        230        240        250
         SYPYEATEES CKYNPKYSVA NDTGFVDIPK QEKALMKAVA TVGPISVAID 260        270        280        290        300
         AGHESFLFYK EGIYFEPDCS SEDMDHGVLV VGYGFESTES DNNKYWLVKN 310        320        330
         SWGEEWGMGG YVKMAKDRRN HCGIASAASY PTV

Q5T8F0
                                                   (SEQ ID NO: 1155)
                 10         20         30         40         50
         MNPTLILAAF CLGIASATLT FDHSLEAQWT KWKAMHNRLY GMNEEGWRRA 60         70         80         90        100
         VWEKNMKMIE LHNQEYREGK HSFTMAMNAF GDMTSEEFRQ VMNGFQNRKP 110        120        130        140        150
         RKGKVFQEPL FYEAPRSVDW REKGYVTPVK NQGQCGSCWA FSATGALEGQ 160        170        180        190        200
         MFRKTGRLIS LSEQNLVDCS GPQGNEGCNG GLMDYAFQYV QDNGGLDSEE 210        220
         SYPYEATVSG APCHHSSSAF GRWTL
```

Dopamine Beta-Hydroxylase (DBH)

```
P09172
                                                   (SEQ ID NO: 1156)
                 10         20         30         40         50
         MPALSRWASL PGPSMREAAF MYSTAVAIFL VILVAALQGS APRESPLPYH 60         70         80         90        100
         IPLDPEGSLE LSWNVSYTQE AIHFQLLVRR LKAGVLFGMS DRGELENADL 110        120        130        140        150
         VVLWTDGDTA YFADAWSDQK GQIHLDPQQD YQLLQVQRTP EGLTLLFKRP 160        170        180        190        200
         FGTCDPKDYL IEDGTVHLVY GILEEPFRSL EAINGSGLQM GLQRVQLLKP 210        220        230        240        250
         NIPEPELPSD ACTMEVQAPN IQIPSQETTY WCYIKELPKG FSRHHIIKYE 260        270        280        290        300
         PIVTKGNEAL VHHMEVFQCA PEMDSVPHFS GPCDSKMKPD RLNYCRHVLA 310        320        330        340        350
         AWALGAKAFY YPEEAGLAFG GPGSSRYLRL EVHYHNPLVI EGRNDSSGIR 360        370        380        390        400
         LYYTAKLRRF NAGIMELGLV YTPVMAIPPR ETAFILTGYC TDKCTQLALP 410        420        430        440        450
         PSGIHIFASQ LHTHLTGRKV VTVLVRDGRE WEIVNQDNHY SPHFQEIRML 460        470        480        490        500
         KKVVSVHPGD VLITSCTYNT EDRELATVGG FGILEEMCVN YVHYYPQTQL 510        520        530        540        550
         ELCKSAVDAG FLQKYFHLIN RFNNEDVCTC PQASVSQQFT SVPWNSFNRD 560        570        580        590        600
         VLKALYSFAP ISMHCNKSSA VRFQGEWNLQ PLPKVISTLE EPTPQCPTSQ

610
         GRSPAGPTVV SIGGGKG
```

Histone H2A.Z(H2AFZ)

P0C0S5
(SEQ ID NO: 1157)
```
         10         20         30         40         50
MAGGKAGKDS GKAKTKAVSR SQRAGLQFPV GRIHRHLKSR TTSHGRVGAT 60         70         80         90        100
AAVYSAAILE YLTAEVLELA GNASKDLKVK RITPRHLQLA IRGDEELDSL 110        120
IKATIAGGGV IPHIHKSLIG KKGQQKTV
```

Q71UI9
(SEQ ID NO: 1158)
```
         10         20         30         40         50
MAGGKAGKDS GKAKAKAVSR SQRAGLQFPV GRIHRHLKTR TTSHGRVGAT 60         70         80         90        100
AAVYSAAILE YLTAEVLELA GNASKDLKVK RITPRHLQLA IRGDEELDSL 110        120
IKATIAGGGV IPHIHKSLIG KKGQQKTA
```

A6NN01
(SEQ ID NO: 1159)
```
         10         20         30         40         50
MAGGKAGKDS GKAKAKAVSR SQRAGLQFPV GRIHRHLKTR TTSHGRVGAT 60         70         80         90        100
AAVYSAAILE YLTAEVLELA GNASKDLKVK RITPRHLQLA IRGDEELDSL 110        120
IKATIAGGGV IPHIHKSLIG KKGQQKTA
```

C9J0D1
(SEQ ID NO: 1160)
```
         10         20         30         40         50
MAGGKAGKDS GKAKAKAVSR SQRAGLQFPV GRIHRHLKTR TTSHGRVGAT 60         70         80         90        100
AAVYSAAILE YLTAEVLELA GNASKDLKVK RITPRHLQLA IRGDEELDSL 110        120
IKATIAGGGM YYYLSLDSYW SF
```

Prolactin-Inducible Protein (PIP)

P12273
(SEQ ID NO: 1161)
```
         10         20         30         40         50
MRLLQLLFRA SPATLLLVLC LQLGANKAQD NTRKIIIKNF DIPKSVRPND 60         70         80         90        100
EVTAVLAVQT ELKECMVVKT YLISSIPLQG AFNYKYTACL CDDNPKTFYW 110        120        130        140
DFYTNRTVQI AAVVDVIREL GICPDDAAVI PIKNNRFYTI EILKVE
```

Isoform VCAM-6D of Vascular Cell Adhesion Protein1 (VCAM1)

P19320-2
(SEQ ID NO: 1162)
```
         10         20         30         40         50
MPGKMVVILG ASNILWIMFA ASQAFKIETT PESRYLAQIG DSVSLTCSTT 60         70         80         90        100
GCESPFFSWR TQIDSPLNGK VTNEGTTSTL TMNPVSFGNE HSYLCTATCE 110        120        130        140        150
SRKLEKGIQV EIYSFPKDPE IHLSGPLEAG KPITVKCSVA DVYPFDRLEI 160        170        180        190        200
DLLKGDHLMK SQEFLEDADR KSLETKSLEV TFTPVIEDIG KVLVCRAKLH
```

```
             210        220        230        240        250
IDEMDSVPTV RQAVKELQVY ISPKNTVISV NPSTKLQEGG SVTMTCSSEG 260        270        280        290        300
LPAPEIFWSK KLDNGNLQHL SGNATLTLIA MRMEDSGIYV CEGVNLIGKN 310        320        330        340        350
RKEVELIVQA FPRDPEIEMS GGLVNGSSVT VSCKVPSVYP LDRLEIELLK 360        370        380        390        400
GETILENIEF LEDTDMKSLE NKSLEMTFIP TIEDTGKALV CQAKLHIDDM 410        420        430        440        450
EFEPKQRQST QTLYVNVAPR DTTVLVSPSS ILEEGSSVNM TCLSQGFPAP 460        470        480        490        500
KILWSRQLPN GELQPLSENA TLTLISTKME DSGVYLCEGI NQAGRSRKEV 510        520        530        540        550
ELIIQVTPKD IKLTAFPSES VKEGDTVIIS CTCGNVPETW IILKKKAETG 560        570        580        590        600
DTVLKSIDGA YTIRKAQLKD AGVYECESKN KVGSQLRSLT LDVQGRENNK 610        620        630        640
DYFSPELLVL YFASSLIIPA IGMIIYFARK ANMKGSYSLV EAQKSKV

P19320                                     (SEQ ID NO: 1163)
             10         20         30         40         50
MPGKMVVILG ASNILWIMFA ASQAFKIETT PESRYLAQIG DSVSLTCSTT 60         70         80         90        100
GCESPFFSWR TQIDSPLNGK VTNEGTTSTL TMNPVSFGNE HSYLCTATCE 110        120        130        140        150
SRKLEKGIQV EIYSFPKDPE IHLSGPLEAG KPITVKCSVA DVYPFDRLEI 160        170        180        190        200
DLLKGDHLMK SQEFLEDADR KSLETKSLEV TFTPVIEDIG KVLVCRAKLH 210        220        230        240        250
IDEMDSVPTV RQAVKELQVY ISPKNTVISV NPSTKLQEGG SVTMTCSSEG 260        270        280        290        300
LPAPEIFWSK KLDNGNLQHL SGNATLTLIA MRMEDSGIYV CEGVNLIGKN 310        320        330        340        350
RKEVELIVQE KPFTVEISPG PRIAAQIGDS VMLTCSVMGC ESPSFSWRTQ 360        370        380        390        400
IDSPLSGKVR SEGTNSTLTL SPVSFENEHS YLCTVTCGHK KLEKGIQVEL 410        420        430        440        450
YSFPRDPEIE MSGGLVNGSS VTVSCKVPSV YPLDRLEIEL LKGETILENI 460        470        480        490        500
EFLEDTDMKS LENKSLEMTF IPTIEDTGKA LVCQAKLHID DMEFEPKQRQ 510        520        530        540        550
STQTLYVNVA PRDTTVLVSP SSILEEGSSV NMTCLSQGFP APKILWSRQL 560        570        580        590        600
PNGELQPLSE NATLTLISTK MEDSGVYLCE GINQAGRSRK EVELIIQVTP 610        620        630        640        650
KDIKLTAFPS ESVKEGDTVI ISCTCGNVPE TWIILKKKAE TGDTVLKSID 660        670        680        690        700
GAYTIRKAQL KDAGVYECES KNKVGSQLRS LTLDVQGREN NKDYFSPELL 710        720        730
VLYFASSLII PAIGMIIYFA RKANMKGSYS LVEAQKSKV

B4DKS4                                     (SEQ ID NO: 1164)
             10         20         30         40         50
MPGKMVVILG ASNILWIMFA ASQAFKIETT PESRYLAQIG DSVSLTCSTT 60         70         80         90        100
GCESPFFSWR TQIDSPLNGK VTNEGTTSTL TMNPVSFGNE HSYLCTATCE
```

```
          110        120        130        140        150
SRKLEKGIQV EIYSFPKDPE IHLSGPLEAG KPITVKCSVA DVYPFDRLEI 160        170        180        190        200
DLLKGDHLMK SQEFLEDADR KSLETKSLEV TFTPVIEDIG KVLVCRAKLH 210        220        230        240        250
IDEMDSVPTV RQAVKELQVY ISPKNTVISV NPSTKLQEGG SVTMTCSSEG 260        270        280        290        300
LPAPEIFWSK KLDNGNLQHL SGNATLTLIA MRMEDSGIYV CEGVNLIGKN 310        320        330        340        350
RKEVELIVQE KPFTVEISPG PRIAAQIGDS VMLTCSVMGC ESPSFSWRTQ 360        370        380        390        400
IDSPLSGKVR SEGTNSTLTL SPVSFENEHS YLCTVTCGHK KLEKGIQVEL 410        420        430        440        450
YSFPRDPEIE MSGGLVNGSS VTVSCKVPSV YPLDRLEIEL LKGETILENI 460        470        480        490        500
EFLEDTDMKS LENKSLEMTF IPTIEDTGKA LVCQAKLHID DMEFEPKQRQ 510        520        530        540        550
STQTLYVNVA PRDTTVLVSP SSILEEGSSV NMTCLSQGFP APKILWSRQL 560        570        580        590        600
PNGELQPLSE NATLTLISTK MEDSGVYLCE GINQAGRSRK EVELIIQVTP 610        620        630        640        650
KDIKLTAFPS ESVKEGDTVI ISCTCGNVPE TWIILKKKAE TGDTVLKSID 660        670        680        690        700
GAYTIRKAQL KDAGVYECES KNKVGSQLRS LTLDVQGREN NKDYFSPELL 710        720        730
VLYFASSLII PAIGMIIYFA RKANMKGSYS LVEAQKSKV

Q53FL7
                                          (SEQ ID NO: 1165)
          10         20         30         40         50
MPGKMVVILG ASNILWIMFA ASQAFKIETT PESRYLAQIG DSVSLTCSTT 60         70         80         90        100
GCESPFFSWR TQIDSPLNGK VTNEGTTSTL TMNPVSFGNE HSYLCTATCE 110        120        130        140        150
SRKLEKGIQV EIYSFPKDPE IHLSGPLEAG KPITVKCSVA DVYPFDRLEI 160        170        180        190        200
DLLKGDHLMK SQEFLEDADR KSLETKSLEV TFTPVIEDIG KVLVCRAKLH 210        220        230        240        250
IDEMDSVPTV RQAVKELQVY ISPKNTVISV NPSTKLQEGG SVTMTCSSEG 260        270        280        290        300
LPAPEIFWSK KLDNGNLQHL SGNATLTLIA MRMEDSGIYV CEGVNLIGKN 310        320        330        340        350
RKEVELIVQE KPFTVEISPG PRIAAQTGDS VMLTCSVMGC ESPSFSWRTQ 360        370        380        390        400
IDSPLSGKVR SEGTNSTLTL SPVSFENEHS YLCTVTCGHK KLEKGIQVEL 410        420        430        440        450
YSFPRDPEIE MSGGLVNGSS VTVSCKVPSV YPLDRLEIEL LKGETILENI 460        470        480        490        500
EFLEDTDMKS LENKSLEMTF IPTIEDTGKA LVCQAKLHID DMEFEPKQRQ 510        520        530        540        550
STQTLYVNVA PRDTTVLVSP SSILEEGSSV NMTCLSQGFP APKILWSRQL 560        570        580        590        600
PNGELQPLSE NATLTLISTK MEDSGVYLCE GINQAGRSRK EVELIIQVTP 610        620        630        640        650
KDIKLTAFPS ESVKEGDTVI ISCTCGNVPE TWIILKKKAE TGDTVLKSID
```

```
               660        670        680        690        700
GAYTIRKAQL KDAGVYECES KNKVGSQLRS LTLDVQGREN NKDYFSPELL 710        720        730
VLYFASSLII PAIGMIIYFA RKANMKGSYS LVEAQKSKV
```

Caspase-14 (CASP14)

```
P31944
                                                (SEQ ID NO: 1166)
          10         20         30         40         50
MSNPRSLEEE KYDMSGARLA LILCVTKARE GSEEDLDALE HMFRQLRFES 60         70         80         90        100
TMKRDPTAEQ FQEELEKFQQ AIDSREDPVS CAFVVLMAHG REGFLKGEDG 110        120        130        140        150
EMVKLENLFE ALNNKNCQAL RAKPKVYIIQ ACRGEQRDPG ETVGGDEIVM 160        170        180        190        200
VIKDSPQTIP TYTDALHVYS TVEGYIAYRH DQKGSCFIQT LVDVFTKRKG 210        220        230        240
HILELLTEVT RRMAEAELVQ EGKARKTNPE IQSTLRKRLY LQ

B2CIS9
                                                (SEQ ID NO: 1167)
          10         20         30         40         50
MSNPRSLEEE KYDMSGARLA LILCVTKARE GSEEDLDALE HMFRQLRFES 60         70         80         90        100
TMKRDPTAEQ FQEELEKFQQ AIDSREDPVS CAFVVLMAHG REGFLKGEDG 110        120        130        140        150
EMVKLENLFE ALNNKNCQAL RAKPKVYIIQ ACRGEQRDPG ETVGGDEIVM 160        170        180        190        200
VIKDSPQTIP TYTDALHVYS TVEGYIAYRH DQKGSCFIQT LVDVFTKRKG 210        220        230        240
HILELLTEVT RRMAEAELVQ EGKARKTNPE IQSTLRKRLY LQ
```

Regulator of G-Protein Signaling 19 (RSG19)

```
P49795
                                                (SEQ ID NO: 1168)
          10         20         30         40         50
MPTPHEAEKQ ITGPEEADRP PSMSSHDTAS PAAPSRNPCC LCWCCCCSCS 60         70         80         90        100
WNQERRRAWQ ASRESKLQPL PSCEVCATPS PEEVQSWAQS FDKLMHSPAG 110        120        130        140        150
RSVFRAFLRT EYSEENMLFW LACEELKAEA NQHVVDEKAR LIYEDYVSIL 160        170        180        190        200
SPKEVSLDSR VREGINKKMQ EPSAHTFDDA QLQIYTLMHR DSYPRFLSSP

210
TYRALLLQGP SQSSSEA

B4DP94
                                                (SEQ ID NO: 1169)
          10         20         30         40         50
MSSHDTASPA APSRNPCCLC WCCCCSCSWN QERRRAWQAS RESKLQPLPS 60         70         80         90        100
CEVCATPSPE EVQSWAQSFD KLMHSPAGRS VFRAFLRTEY SEENMLFWLA 110        120        130        140        150
CEELKAEANQ HVVDEKARLI YEDYVSILSP KEVSLDSRVR EGINKKMQEP 160        170        180        190
SAHTFDDAQL QIYTLMHRDS YPRFLSSPTY RALLLQGPSQ SSSEA

Q6I9S5
```

-continued (SEQ ID NO: 1170)
```
         10         20         30         40         50
MPTPHEAEKQ ITGPEEADRP PSMSSHDTAS PAAPSRNPCC LCWCCCCSCS 60         70         80         90        100
WNQERRRAWQ ASRESKLQPL PSCEVCATPS PEEVQSWAQS FGKLMHSPAG 110        120        130        140        150
RSVFRAFLRT EYSEENMLFW LACEELKAEA NQHVVDEKAR LIYEDYVSIL 160        170        180        190        200
SPKEVSLDSR VREGINKKMQ EPSAHTFDDA QLQIYTLMHR DSYPRFLSSP

210
TYRALLLQGP SQSSSEA
```

Cathelicidin Antimicrobial Peptide (CAMP Includes EG:12796)

P49913

(SEQ ID NO: 1171)
```
         10         20         30         40         50
MKTQRDGHSL GRWSLVLLLL GLVMPLAIIA QVLSYKEAVL RAIDGINQRS 60         70         80         90        100
SDANLYRLLD LDPRPTMDGD PDTPKPVSFT VKETVCPRTT QQSPEDCDFK 110        120        130        140        150
KDGLVKRCMG TVTLNQARGS FDISCDKDNK RFALLGDFFR KSKEKIGKEF 160        170
KRIVQRIKDF LRNLVPRTES
```

Desmoglein-1 (DSG1)1

Q02413

(SEQ ID NO: 1172)
```
         10         20         30         40         50
MDWSFFRVVA MLFIFLVVVE VNSEFRIQVR DYNTKNGTIK WHSIRRQKRE 60         70         80         90        100
WIKFAAACRE GEDNSKRNPI AKIHSDCAAN QQVTYRISGV GIDQPPYGIF 110        120        130        140        150
VINQKTGEIN ITSIVDREVT PFFIIYCRAL NSMGQDLERP LELRVRVLDI 160        170        180        190        200
NDNPPVFSMA TFAGQIEENS NANTLVMILN ATDADEPNNL NSKIAFKIIR 210        220        230        240        250
QEPSDSPMFI INRNTGEIRT MNNFLDREQY GQYALAVRGS DRDGGADGMS 260        270        280        290        300
AECECNIKIL DVNDNIPYME QSSYTIEIQE NTLNSNLLEI RVIDLDEEFS 310        320        330        340        350
ANWMAVIFFI SGNEGNWFEI EMNERTNVGI LKVVKPLDYE AMQSLQLSIG 360        370        380        390        400
VRNKAEFHHS IMSQYKLKAS AISVTVLNVI EGPVFRPGSK TYVVTGNMGS 410        420        430        440        450
NDKVGDFVAT DLDTGRPSTT VRYVMGNNPA DLLAVDSRTG KLTLKNKVTK 460        470        480        490        500
EQYNMLGGKY QGTILSIDDN LQRTCTGTIN INIQSFGNDD RTNTEPNTKI 510        520        530        540        550
TTNTGRQEST SSTNYDTSTT STDSSQVYSS EPGNGAKDLL SDNVHFGPAG 560        570        580        590        600
IGLLIMGFLV LGLVPFLMIC CDCGGAPRSA AGFEPVPECS DGAIHSWAVE 610        620        630        640        650
GPQPEPRDIT TVIPQIPPDN ANIIECIDNS GVYTNEYGGR EMQDLGGGER
```

-continued

```
           660        670        680        690        700
     MTGFELTEGV KTSGMPEICQ EYSGTLRRNS MRECREGGLN MNFMESYFCQ 710        720        730        740        750
     KAYAYADEDE GRPSNDCLLI YDIEGVGSPA GSVGCCSFIG EDLDDSFLDT 760        770        780        790        800
     LGPKFKKLAD ISLGKESYPD LDPSWPPQST EPVCLPQETE PVVSGHPPIS 810        820        830        840        850
     PHFGTTTVIS ESTYPSGPGV LHPKPILDPL GYGNVTVTES YTTSDTLKPS 860        870        880        890        900
     VHVHDNRPAS NVVVTERVVG PISGADLHGM LEMPDLRDGS NVIVTERVIA 910        920        930        940        950
     PSSSLPTSLT IHHPRESSNV VVTERVIQPT SGMIGSLSMH PELANAHNVI 960        970        980        990       1000
     VTERVVSGAG VTGISGTTGI SGGIGSSGLV GTSMGAGSGA LSGAGISGGG 1010       1020       1030       1040
     IGLSSLGGTA SIGHMRSSSD HHFNQTIGSA SPSTARSRIT KYSTVQYSK
```

Protein-Glutamine Gamma-Glutamyltransferase E (TGM3)

```
     Q08188
                                               (SEQ ID NO: 1173)
            10         20         30         40         50
     MAALGVQSIN WQTAFNRQAH HTDKFSSQEL ILRRGQNFQV LMIMNKGLGS 60         70         80         90        100
     NERLEFIVST GPYPSESAMT KAVFPLSNGS SGGWSAVLQA SNGNTLTISI 110        120        130        140        150
     SSPASAPIGR YTMALQIFSQ GGISSVKLGT FILLFNPWLN VDSVFMGNHA 160        170        180        190        200
     EREEYVQEDA GIIFVGSTNR IGMIGWNFGQ FEEDILSICL SILDRSLNFR 210        220        230        240        250
     RDAATDVASR NDPKYVGRVL SAMINSNDDN GVLAGNWSGT YTGGRDPRSW 260        270        280        290        300
     NGSVEILKNW KKSGFSPVRY GQCWVFAGTL NTALRSLGIP SRVITNFNSA 310        320        330        340        350
     HDTDRNLSVD VYYDPMGNPL DKGSDSVWNF HVWNEGWFVR SDLGPSYGGW 360        370        380        390        400
     QVLDATPQER SQGVFQCGPA SVIGVREGDV QLNFDMPFIF AEVNADRITW 410        420        430        440        450
     LYDNTTGKQW KNSVNSHTIG RYISTKAVGS NARMDVTDKY KYPEGSDQER 460        470        480        490        500
     QVFQKALGKL KPNTPFAATS SMGLETEEQE PSIIGKLKVA GMLAVGKEVN 510        520        530        540        550
     LVLLLKNLSR DTKTVTVNMT AWTIIYNGTL VHEVWKDSAT MSLDPEEEAE 560        570        580        590        600
     HPIKISYAQY EKYLKSDNMI RITAVCKVPD ESEVVVERDI ILDNPTLTLE 610        620        630        640        650
     VLNEARVRKP VNVQMLFSNP LDEPVRDCVL MVEGSGLLLG NLKIDVPTLG 660        670        680        690
     PKEGSRVRFD ILPSRSGTKQ LLADFSCNKF PAIKAMLSID VAE

B4DQ50
                                               (SEQ ID NO: 1174)
            10         20         30         40         50
     MAALGVQSIN WQKAFNRQAH HTDKFSSQEL ILRRGQNFQV LMIMNKGLGS 60         70         80         90        100
     NERLEFIVST GPYPSESAMT KAVFPLSNGS SGGWSAVLQA SNGNTLTISI 110        120        130        140        150
```

```
                                            -continued
SSPASAPIGR YTMALQIFSQ GGISSVKLGT FILLFNPWLN VDSVFMGNHA 160        170        180        190        200
EREEYVQEDA GIIFVGSTNR IGMIGWNFGQ FEEDILSICL SILDRSLNFR 210        220        230        240        250
RDAATDVASR NDPKYVGRVL SAMINSNDDN GVLAGNWSGT YTGGRDPRSW 260        270        280        290        300
NGSVEILKNW KKSGFSPVRY GQCWVFAGTL NTALRSLGIP SRVITNFNSA 310        320        330        340        350
HDTDRNLSVD VYYDPMGNPL DKGSDSVWNF HVWNEGWFVR SDLGPSYGGW 360        370        380        390        400
QVLDATPQER SQGVFQCGPA SVIGVREGDV QLNFDMPFIF AEVNADRITW 410        420        430        440        450
LYDNTTGKQW KNSVNSHTIG RYISTKAVGS NARMDVTDKY KYPEGSDQER 460        470        480        490        500
QVFQKALGKL KPNTPFAATS SMGLETEEQE PSIIGKLKVA GMLAVGKEVN 510        520        530
LVLLLIPHAL QCCRMDWPLT QGLSKRDTGE KIN D3DVX1
                                              (SEQ ID NO: 1175)
        10         20         30         40         50
MAALGVQSIN WQTAFNRQAH HTDKFSSQEL ILRRGQNFQV LMIMNKGLGS 60         70         80         90        100
NERLEFIVST GPYPSESAMT KAVFPLSNGS SGGWSAVLQA SNGNTLTISI 110        120        130        140        150
SSPASAPIGR YTMALQIFSQ GGISSVKLGT FILLFNPWLN VDSVFMGNHA 160        170        180        190        200
EREEYVQEDA GIIFVGSTNR IGMIGWNFGQ FEEDILSICL SILDRSLNFR 210        220        230        240        250
RDAATDVASR NDPKYVGRVL SAMINSNDDN GVLAGNWSGT YTGGRDPRSW 260        270        280        290        300
NGSVEILKNW KKSGFSPVRY GQCWVFAGTL NTALRSLGIP SRVITNFNSA 310        320        330        340        350
HDTDRNLSVD VYYDPMGNPL DKGSDSVWNF HVWNEGWFVR SDLGPSYGGW 360        370        380        390        400
QVLDATPQER SQGVFQCGPA SVIGVREGDV QLNFDMPFIF AEVNADRITW 410        420        430        440        450
LYDNTTGKQW KNSVNSHTIG RYISTKAVGS NARMDVTDKY KYPEGSDQER 460        470        480        490        500
QVFQKALGKL KPNTPFAATS SMGLETEEQE PSIIGKLKVA GMLAVGKEVN 510        520        530        540        550
LVLLLKNLSR DTKTVTVNMT AWTIIYNGTL VHEVWKDSAT MSLDPEEEAE 560        570        580        590        600
HPIKISYAQY EKYLKSDNMI RITAVCKVPD ESEVVVERDI ILDNPTLTLE 610        620        630        640        650
VLNEARVRKP VNVQMLFSNP LDEPVRDCVL MVEGSGLLLG NLKIDVPTLG 660        670        680        690
PKEGSRVRFD ILPSRSGTKQ LLADFSCNKF PAIKAMLSID VAE
```

Bleomycin Hydrolase (BLMH)

```
Q13867
                                              (SEQ ID NO: 1176)
        10         20         30         40         50
MSSSGLNSEK VAALIQKLNS DPQFVLAQNV GTTHDLLDIC LKRATVQRAQ 60         70         80         90        100
HVFQHAVPQE GKPITNQKSS GRCWIFSCLN VMRLPFMKKL NIEEFEFSQS
```

```
              110        120        130        140        150
       YLFFWDKVER CYFFLSAFVD TAQRKEPEDG RLVQFLLMNP ANDGGQWDML 160        170        180        190        200
       VNIVEKYGVI PKKCFPESYT TEATRRMNDI LNHKMREFCI RLRNLVHSGA 210        220        230        240        250
       TKGEISATQD VMMEEIFRVV CICLGNPPET FTWEYRDKDK NYQKIGPITP 260        270        280        290        300
       LEFYREHVKP LFNMEDKICL VNDPRPQHKY NKLYTVEYLS NMVGGRKTLY 310        320        330        340        350
       NNQPIDFLKK MVAASIKDGE AVWFGCDVGK HFNSKLGLSD MNLYDHELVF 360        370        380        390        400
       GVSLKNMNKA ERLTFGESLM THAMTFTAVS EKDDQDGAFT KWRVENSWGE 410        420        430        440        450
       DHGHKGYLCM TDEWFSEYVY EVVVDRKHVP EEVLAVLEQE PIILPAWDPM

GALAE

Protein FAM136A (FAM136A)
Q96C01
                                                 (SEQ ID NO: 1177)
               10         20         30         40         50
       MAELQQLRVQ EAVESMVKSL ERENIRKMQG LMFRCSASCC EDSQASMKQV 60         70         80         90        100
       HQCIERCHVP LAQAQALVTS ELEKFQDRLA RCTMHCNDKA KDSIDAGSKE 110        120        130
       LQVKQQLDSC VTKCVDDHMH LIPTMTKKMK EALLSIGK B0AZT6
                                                 (SEQ ID NO: 1178)
               10         20         30         40         50
       MFRCSASCCE DSQASMKQVH QCIERCHVPL AQAQALVTSE LEKFQDRLAR 60         70         80         90        100
       CTMHCNDKAK DSIDAGSKEL QVKQQLDSCV TKCVDDHMHL IPTMTKKMKE

ALLSIGK

C9JF51
                                                 (SEQ ID NO: 1179)
               10         20         30         40         50
       MVKSLERENI RKMQVAGLGP NQDPLLSGWV PGPSLSHHAT PCTAAASPQ 60         70         80         90        100
       GCGRPWGRRG GLGQDFGSFG GSDEIRVPLP CARLFSAPSS PGQERPRRQ 110        120        130        140        150
       LMFRCSASCC EDSQASMKQV HQCIERCHVP LAQAQALVTS ELEKFQDRL

160
       RCTMHCNDKA KDS

Protein S100-A6 (S100A6)
P06703
                                                 (SEQ ID NO: 1180)
               10         20         30         40         50
       MACPLDQAIG LLVAIFHKYS GREGDKHTLS KKELKELIQK ELTIGSKLQD 60         70         80         90
       AEIARLMEDL DRNKDQEVNF QEYVTFLGAL ALIYNEALKG D3DV39
                                                 (SEQ ID NO: 1181)
               10         20         30         40         50
       MACPLDQAIG LLVAIFHKYS GREGDKHTLS KKELKELIQK ELTIGSKLQD 60         70         80         90
       AEIARLMEDL DRNKDQEVNF QEYVTFLGAL ALIYNEALKG
```

Isoform H14 of Myeloperoxidase (MPO)

P05164-2
(SEQ ID NO: 1182)

```
          10         20         30         40         50
   MELLSYFKQP VAATRTAVRA ADYLHVALDL LERKLRSLWR RPFNVTDVLT 60         70         80         90        100
   PAQLNVLSKS SGCAYQDVGV TCPEQDKYRT ITGMCNNRRS PTLGASNRAF 110        120        130        140        150
   VRWLPAEYED GFSLPYGWTP GVKRNGFPVA LARAVSNEIV RFPTDQLTPD 160        170        180        190        200
   QERSLMFMQW GQLLDHDLDF TPEPAARASF VTGVNCETSC VQQPPCFPLK 210        220        230        240        250
   IPPNDPRIKN QADCIPFFRS CPACPGSNIT IRNQINALTS FVDASMVYGS 260        270        280        290        300
   EEPLARNLRN MSNQLGLLAV NQRFQDNGRA LLPFDNLHDD PCLLTNRSAR 310        320        330        340        350
   IPCFLAGDTR SSEMPELTSM HTLLLREHNR LATELKSLNP RWDGERLYQE 360        370        380        390        400
   ARKIVGAMVQ IITYRDYLPL VLGPTAMRKY LPTYRSYNDS VDPRIANVFT 410        420        430        440        450
   NAFRYGHTLI QPFMFRLDNR YQPMEPNPRV PLSRVFFASW RVVLEGGIDP 460        470        480        490        500
   ILRGLMATPA KLNRQNQIAV DEIRERLFEQ VMRIGLDLPA LNMQRSRDHG 510        520        530        540        550
   LPGYNAWRRF CGLPQPETVG QLGTVLRNLK LARKLMEQYG TPNNIDIWMG 560        570        580        590        600
   GVSEPLKRKG RVGPLLACII GTQFRKLRDG DRFWWENEGV FSMQQRQALA 610        620        630        640        650
   QISLPRIICD NTGITTVSKN NIFMSNSYPR DFVNCSTLPA LNLASWREAS
```

P05164-3
(SEQ ID NO: 1183)

```
          10         20         30         40         50
   MGVPFFSSLR CMVDLGPCWA GGLTAEMKLL LALAGLLAIL ATPQPSEGAA 60         70         80         90        100
   PAVLGEVDTS LVLSSMEEAK QLVDKAYKER RESIKQRLRS GSASPMELLS 110        120        130        140        150
   YFKQPVAATR TAVRAADYLH VALDLLERKL RSLWRRPFNV TDVLTPAQLN 160        170        180        190        200
   VLSKSSGCAY QDVGVTCPEQ DKYRTITGMC NNRCGWLGVA AGTGLREASR 210        220        230        240        250
   TPQASRCQRP VLPCRRSPTL GASNRAFVRW LPAEYEDGFS LPYGWTPGVK 260        270        280        290        300
   RNGFPVALAR AVSNEIVRFP TDQLTPDQER SLMFMQWGQL LDHDLDFTPE 310        320        330        340        350
   PAARASFVTG VNCETSCVQQ PPCFPLKIPP NDPRIKNQAD CIPFFRSCPA 360        370        380        390        400
   CPGSNITIRN QINALTSFVD ASMVYGSEEP LARNLRNMSN QLGLLAVNQR 410        420        430        440        450
   FQDNGRALLP FDNLHDDPCL LTNRSARIPC FLAGDTRSSE MPELTSMHTL 460        470        480        490        500
   LLREHNRLAT ELKSLNPRWD GERLYQEARK IVGAMVQIIT YRDYLPLVLG 510        520        530        540        550
   PTAMRKYLPT YRSYNDSVDP RIANVFTNAF RYGHTLIQPF MFRLDNRYQP 560        570        580        590        600
   MEPNPRVPLS RVFFASWRVV LEGGIDPILR GLMATPAKLN RQNQIAVDEI
```

-continued

```
           610        620        630        640        650
RERLFEQVMR IGLDLPALNM QRSRDHGLPG YNAWRRFCGL PQPETVGQLG 660        670        680        690        700
TVLRNLKLAR KLMEQYGTPN NIDIWMGGVS EPLKRKGRVG PLLACIIGTQ 710        720        730        740        750
FRKLRDGDRF WWENEGVFSM QQRQALAQIS LPRIICDNTG ITTVSKNNIF 760        770
MSNSYPRDFV NCSTLPALNL ASWREAS

P05164
                                                  (SEQ ID NO: 1184)
           10         20         30         40         50
MGVPFFSSLR CMVDLGPCWA GGLTAEMKLL LALAGLLAIL ATPQPSEGAA 60         70         80         90         100
PAVLGEVDTS LVLSSMEEAK QLVDKAYKER RESIKQRLRS GSASPMELLS 110        120        130        140        150
YFKQPVAATR TAVRAADYLH VALDLLERKL RSLWRRPFNV TDVLTPAQLN 160        170        180        190        200
VLSKSSGCAY QDVGVTCPEQ DKYRTITGMC NNRRSPTLGA SNRAFVRWLP 210        220        230        240        250
AEYEDGFSLP YGWTPGVKRN GFPVALARAV SNEIVRFPTD QLTPDQERSL 260        270        280        290        300
MFMQWGQLLD HDLDFTPEPA ARASFVTGVN CETSCVQQPP CFPLKIPPND 310        320        330        340        350
PRIKNQADCI PFFRSCPACP GSNITIRNQI NALTSFVDAS MVYGSEEPLA 360        370        380        390        400
RNLRNMSNQL GLLAVNQRFQ DNGRALLPFD NLHDDPCLLT NRSARIPCFL 410        420        430        440        450
AGDTRSSEMP ELTSMHTLLL REHNRLATEL KSLNPRWDGE RLYQEARKIV 460        470        480        490        500
GAMVQIITYR DYLPLVLGPT AMRKYLPTYR SYNDSVDPRI ANVFTNAFRY 510        520        530        540        550
GHTLIQPFMF RLDNRYQPME PNPRVPLSRV FFASWRVVLE GGIDPILRGL 560        570        580        590        600
MATPAKLNRQ NQIAVDEIRE RLFEQVMRIG LDLPALNMQR SRDHGLPGYN 610        620        630        640        650
AWRRFCGLPQ PETVGQLGTV LRNLKLARKL MEQYGTPNNI DIWMGGVSEP 660        670        680        690        700
LKRKGRVGPL LACIIGTQFR KLRDGDRFWW ENEGVFSMQQ RQALAQISLP 710        720        730        740
RIICDNTGIT TVSKNNIFMS NSYPRDFVNC STLPALNLAS WREAS
```

Isoform 2 of Neutrophil Gelatinase-Associated Lipocalin (LCN2)

```
P80188-2
                                                  (SEQ ID NO: 1185)
           10         20         30         40         50
MPLGLLWLGL ALLGALHAQA QDSTSDLIPA PPLSKVPLQQ NFQDNQFQGK 60         70         80         90         100
WYVVGLAGNA ILREDKDPQK MYATIYELKE DKSYNVTSVL FRKKKCDYWI 110        120        130        140        150
RTFVPGCQPG EFTLGNIKSY PGLTSYLVRV VSTNYNQHAM VFFKKVSQNR 160        170        180        190
EYFKITLYGR TKELTSELKE NFIRFSKSLG LPENHIVFPV PIGNGQSG

P80188
```

```
                                                  (SEQ ID NO: 1186)
         10         20         30         40         50
MPLGLLWLGL ALLGALHAQA QDSTSDLIPA PPLSKVPLQQ NFQDNQFQGK 60         70         80         90        100
WYVVGLAGNA ILREDKDPQK MYATIYELKE DKSYNVTSVL FRKKKCDYWI 110        120        130        140        150
RTFVPGCQPG EFTLGNIKSY PGLTSYLVRV VSTNYNQHAM VFFKKVSQNR 160        170        180        190
EYFKITLYGR TKELTSELKE NFIRFSKSLG LPENHIVFPV PIDQCIDG

B2ZDQ1
                                                  (SEQ ID NO: 1187)
         10         20         30         40         50
MVPLGLLWLG LALLGALHAQ AQDSTSDLIP APPLSKVPLQ QNFQDNQFQG 60         70         80         90        100
KWYVVGLAGN AILREDKDPQ KMYATIYELK EDKSYNVTSV LFRKKKCDYW 110        120        130        140        150
IRTFVPGCQP GEFTLGNIKS YPGLTSYLVR VVSTNYNQHA MVFFKKVSQN 160        170        180        190
REYFKITLYG RTKELTSELK ENFIRFSKSL GLPENHIVFP VPIDQCIDG
```

Beta-Ala-His Dipeptidase (CNDP1)

```
Q96KN2
                                                  (SEQ ID NO: 1188)
         10         20         30         40         50
MDPKLGRMAA SLLAVLLLLL ERGMFSSPSP PPALLEKVFQ YIDLHQDEFV 60         70         80         90        100
QTLKEWVAIE SDSVQPVPRF RQELFRMMAV AADTLQRLGA RVASVDMGPQ 110        120        130        140        150
QLPDGQSLPI PPIILAELGS DPTKGTVCFY GHLDVQPADR GDGWLTDPYV 160        170        180        190        200
LTEVDGKLYG RGATDNKGPV LAWINAVSAF RALEQDLPVN IKFIIEGMEE 210        220        230        240        250
AGSVALEELV EKEKDRFFSG VDYIVISDNL WISQRKPAIT YGTRGNSYFM 260        270        280        290        300
VEVKCRDQDF HSGTFGGILH EPMADLVALL GSLVDSSGHI LVPGIYDEVV 310        320        330        340        350
PLTEEEINTY KAIHLDLEEY RNSSRVEKFL FDTKEEILMH LWRYPSLSIH 360        370        380        390        400
GIEGAFDEPG TKTVIPGRVI GKFSIRLVPH MNVSAVEKQV TRHLEDVFSK 410        420        430        440        450
RNSSNKMVVS MTLGLHPWIA NIDDTQYLAA KRAIRTVFGT EPDMIRDGST 460        470        480        490        500
IPIAKMFQEI VHKSVVLIPL GAVDDGEHSQ NEKINRWNYI EGTKLFAAFF

LEMAQLH

A8K1K1
                                                  (SEQ ID NO: 1189)
         10         20         30         40         50
MDPKLGRMAA SLLAVLLLLL ERGMFSSPSP PPALLEKVFQ YIDLHQDEFV 60         70         80         90        100
QTLKEWVAIE SDSVQPVPRF RQELFRMMAV AADTLQRLGV RVASVDMGPQ 110        120        130        140        150
QLPDGQSLPI PPVILAELGS DPTKGTVCFY GHLDVQPADR GDGWLTDPYV 160        170        180        190        200
LTEVDGKLYG RGATDNKGPV LAWINAVSAF RALEQDLPVN IKFIIEGMEE 210        220        230        240        250
AGSVALEELV EKEKDRFFSG VDYIVISDNL WISQRKPAIT YGTRGNSYFM
```

-continued

```
                260        270        280        290        300
         VEVKCRDQDF HSGTFGGILH EPMADLVALL GSLVDSSGHI LVPGIYDEVV 310        320        330        340        350
         PLTEEEINTY KAIHLDLEEY RNSSRVEKFL FDTKEEILMH LWRYPSLSIH 360        370        380        390        400
         GIEGAFDEPG TKTVIPGRVI GKFSIRLVPH MNVSAVEKQV TRHLEDVFSK 410        420        430        440        450
         RKSSNKMVVS MTLGLHPWIA NIDDTQYLAA KRAIRTVFGT EPDMIRDGST 460        470        480        490        500
         IPIAKMFQEI VHKSVVLIPL GAVDDGEHSQ NEKINRWNYI EGTKLFAAFF

LEMAQLH

B4E180
                                                       (SEQ ID NO: 1190)
                 10         20         30         40         50
         MDPKLGRMAA SLLAVLLLLL ERGMFSSPSP PPALLEKVFQ YIDLHQDEFV 60         70         80         90        100
         QTLKEWVAIE SDSVQPVPRF RQELFRMMAV AADTLQQLPD GQSLPIPPVI 110        120        130        140        150
         LAELGSDPTK GTVCFYGHLD VQPADRGDGW LTDPYVLTEV DGKLYGRGAT 160        170        180        190        200
         DNKGPVLAWI NAVSAFRALE QDLPVNIKFI IEGMEEAGSV ALEELVEKEK 210        220        230        240        250
         DRFFSGVDYI VISDNLWISQ RKPAITYGTR GNSYFMVEVK CRDQDFHSGT 260        270        280        290        300
         FGGILHEPMA DLVALLGSLV DSSGHILVPG IYDEVVPLTE EEINTYKAIH 310        320        330        340        350
         LDLEEYRNSS RVEKFLFDTK EEILMHLWRY PSLSIHGIEG AFDEPGTKTV 360        370        380        390        400
         IPGRVIGKFS IRLVPHMNVS AVEKQVTRHL EDVFSKRNSS NKMVVSMTLG 410 420        430        440        450
         LHPWIANIDD TQYLAAKRAI RTVFGTEPDM IRDGSTIPIA KMFQEIVHKS 460        470        480        490
         VVLIPLGAVD DGEHSQNEKI NRWNYIEGTK LFAAFFLEMA QLH
```

Catalase (CAT)

```
P04040
                                                       (SEQ ID NO: 1191)
                 10         20         30         40         50
         MADSRDPASD QMQHWKEQRA AQKADVLTTG AGNPVGDKLN VITVGPRGPL 60         70         80         90        100
         LVQDVVFTDE MAHFDRERIP ERVVHAKGAG AFGYFEVTHD ITKYSKAKVF 110        120        130        140        150
         EHIGKKTPIA VRFSTVAGES GSADTVRDPR GFAVKFYTED GNWDLVGNNT 160        170        180        190        200
         PIFFIRDPIL FPSFIHSQKR NPQTHLKDPD MVWDFWSLRP ESLHQVSFLF 210        220        230        240        250
         SDRGIPDGHR HMNGYGSHTF KLVNANGEAV YCKFHYKTDQ GIKNLSVEDA 260        270        280        290        300
         ARLSQEDPDY GIRDLFNAIA TGKYPSWTFY IQVMTFNQAE TFPFNPFDLT 310        320        330        340        350
         KVWPHKDYPL IPVGKLVLNR NPVNYFAEVE QIAFDPSNMP PGIEASPDKM 360        370        380        390        400
         LQGRLFAYPD THRHRLGPNY LHIPVNCPYR ARVANYQRDG PMCMQDNQGG 410        420        430        440        450
```

-continued
```
APNYYPNSFG APEQQPSALE HSIQYSGEVR RFNTANDDNV TQVRAFYVNV 460        470        480        490        500
LNEEQRKRLC ENIAGHLKDA QIFIQKKAVK NFTEVHPDYG SHIQALLDKY 510        520
NAEKPKNAIH TFVQSGSHLA AREKANL D3DR07
                                                (SEQ ID NO: 1192)
        10         20         30         40         50
MADSRDPASD QMQHWKEQRA AQKADVLTTG AGNPVGDKLN VITVGPRGPL 60         70         80         90        100
LVQDVVFTDE MAHFDRERIP ERVVHAKGAG AFGYFEVTHD ITKYSKAKVF 110        120        130        140        150
EHIGKKTPIA VRFSTVAGES GSADTVRDPR GFAVKFYTED GNWDLVGNNT 160        170        180        190        200
PIFFIRDPIL FPSFIHSQKR NPQTHLKDPD MVWDFWSLRP ESLHQVSFLF 210        220        230        240        250
SDRGIPDGHR HMNGYGSHTF KLVNANGEAV YCKFHYKTDQ GIKNLSVEDA 260        270        280        290        300
ARLSQEDPDY GIRDLFNAIA TGKYPSWTFY IQVMTFNQAE TFPFNPFDLT 310        320        330        340        350
KVWPHKDYPL IPVGKLVLNR NPVNYFAEVE QIAFDPSNMP PGIEASPDKM 360        370        380        390        400
LQGRLFAYPD THRHRLGPNY LHIPVNCPYR ARVANYQRDG PMCMQDNQGG 410        420        430        440        450
APNYYPNSFG APEQQPSALE HSIQYSGEVR RFNTANDDNV TQVRAFYVNV 460        470        480        490        500
LNEEQRKRLC ENIAGHLKDA QIFIQKKAVK NFTEVHPDYG SHIQALLDKY 510        520
NAEKPKNAIH TFVQSGSHLA AREKANL
```

Desmoplakin (DSP)

```
P15924
                                                (SEQ ID NO: 1193)
        10         20         30         40         50
MSCNGGSHPR INTLGRMIRA ESGPDLRYEV TSGGGGTSRM YYSRRGVITD 60         70         80         90        100
QNSDGYCQTG TMSRHQNQNT IQELLQNCSD CLMRAELIVQ PELKYGDGIQ 110        120        130        140        150
LTRSRELDEC FAQANDQMEI LDSLIREMRQ MGQPCDAYQK RLLQLQEQMR 160        170        180        190        200
ALYKAISVPR VRRASSKGGG GYTCQSGSGW DEFTKHVTSE CLGWMRQQRA 210        220        230        240        250
EMDMVAWGVD LASVEQHINS HRGIHNSIGD YRWQLDKIKA DLREKSAIYQ 260        270        280        290        300
LEEEYENLLK ASFERMDHLR QLQNIIQATS REIMWINDCE EEELLYDWSD 310        320        330        340        350
KNTNIAQKQE AFSIRMSQLE VKEKELNKLK QESDQVLNLQ HPASDKIEAY 360        370        380        390        400
MDTLQTQWSW ILQITKCIDV HLKENAAYFQ FFEEAQSTEA YLKGLQDSIR 410        420        430        440        450
KKYPCDKNMP LQHLLEQIKE LEKEREKILE YKRQVQNLVN KSKKIVQLKP 460        470        480        490        500
RNPDYRSNKP IILRALCDYK QDQKIVHKGD ECILKDNNER SKWYVTGPGG 510        520        530        540        550
VDMLVPSVGL IIPPPNPLAV DLSCKIEQYY EAILALWNQL YINMKSLVSW
```

```
      560        570        580        590        600
HYCMIDIEKI RAMTIAKLKT MRQEDYMKTI ADLELHYQEF IRNSQGSEMF 610        620        630        640        650
GDDDKRKIQS QFTDAQKHYQ TLVIQLPGYP QHQTVTTTEI THHGTCQDVN 660        670          6        690        700
HNKVIETNRE NDKQETWMLM ELQKIRRQIE HCEGRMTLKN LPLADQGSSH 710        720        730        740        750
HITVKINELK SVQNDSQAIA EVLNQLKDML ANFRGSEKYC YLQNEVFGLF 760        770        780        790        800
QKLENINGVT DGYLNSLCTV RALLQAILQT EDMLKVYEAR LTEEETVCLD 810        820        830        840        850
LDKVEAYRCG LKKIKNDLNL KKSLLATMKT ELQKAQQIHS QTSQQYPLYD 860        870        880        890        900
LDLGKFGEKV TQLTDRWQRI DKQIDFRLWD LEKQIKQLRN YRDNYQAFCK 910        920        930        940        950
WLYDAKRRQD SLESMKFGDS NTVMRFLNEQ KNLHSEISGK RDKSEEVQKI 960        970        980        990       1000
AELCANSIKD YELQLASYTS GLETLLNIPI KRTMIQSPSG VILQEAADVH 1010       1020       1030       1040       1050
ARYIELLTRS GDYYRFLSEM LKSLEDLKLK NTKIEVLEEE LRLARDANSE 1060       1070       1080       1090       1100
NCNKNKFLDQ NLQKYQAECS QFKAKLASLE ELKRQAELDG KSAKQNLDKC 1110       1120       1130       1140       1150
YGQIKELNEK ITRLTYEIED EKRRRKSVED RFDQQKNDYD QLQKARQCEK 1160       1170       1180       1190       1200
ENLGWQKLES EKAIKEKEYE IERLRVLLQE EGTRKREYEN ELAKVRNHYN 1210       1220       1230       1240       1250
EEMSNLRNKY ETEINITKTT IKEISMQKED DSKNLRNQLD RLSRENRDLK 1260       1270       1280       1290       1300
DEIVRLNDSI LQATEQRRRA EENALQQKAC GSEIMQKKQH LEIELKQVMQ 1310       1320       1330       1340       1350
QRSEDNARHK QSLEEAAKTI QDKNKEIERL KAEFQEEAKR RWEYENELSK 1360       1370       1380       1390       1400
VRNNYDEEII SLKNQFETEI NITKTTIHQL TMQKEEDTSG YRAQIDNLTR 1410       1420       1430       1440       1450
ENRSLSEEIK RLKNTLTQTT ENLRRVEEDI QQQKATGSEV SQRKQQLEVE 1460       1470       1480       1490       1500
LRQVTQMRTE ESVRYKQSLD DAAKTIQDKN KEIERLKQLI DKETNDRKCL 1510       1520       1530       1540       1550
EDENARLQRV QYDLQKANSS ATETINKLKV QEQELTRLRI DYERVSQERT 1560       1570       1580       1590       1600
VKDQDITRFQ NSLKELQLQK QKVEEELNRL KRTASEDSCK RKKLEEELEG 1610       1620       1630       1640       1650
MRRSLKEQAI KITNLTQQLE QASIVKKRSE DDLRQQRDVL DGHLREKQRT 1660       1670       1680       1690       1700
QEELRRLSSE VEALRRQLLQ EQESVKQAHL RNEHFQKAIE DKSRSLNESK 1710       1720       1730       1740       1750
IEIERLQSLT ENLTKEHLML EEELRNLRLE YDDLRRGRSE ADSDKNATIL 1760       1770       1780       1790       1800
ELRSQLQISN NRTLELQGLI NDLQRERENL RQEIEKFQKQ ALEASNRIQE 1810       1820       1830       1840       1850
SKNQCTQVVQ ERESLLVKIK VLEQDKARLQ RLEDELNRAK STLEAETRVK 1860       1870       1880       1890       1900
QRLECEKQQI QNDLNQWKTQ YSRKEEAIRK IESEREKSER EKNSLRSEIE
```

-continued

```
        1910       1920       1930       1940       1950
RLQAEIKRIE ERCRRKLEDS TRETQSQLET ERSRYQREID KLRQRPYGSH 1960       1970       1980       1990       2000
RETQTECEWT VDTSKLVFDG LRKKVTAMQL YECQLIDKTT LDKLLKGKKS 2010       2020       2030       2040       2050
VEEVASEIQP FLRGAGSIAG ASASPKEKYS LVEAKRKKLI SPESTVMLLE 2060       2070       2080       2090       2100
AQAATGGIID PHRNEKLTVD SAIARDLIDF DDRQQIYAAE KAITGFDDPF 2110       2120       2130       2140       2150
SGKTVSVSEA IKKNLIDRET GMRLLEAQIA SGGVVDPVNS VFLPKDVALA 2160       2170       2180       2190       2200
RGLIDRDLYR SLNDPRDSQK NFVDPVTKKK VSYVQLKERC RIEPHTGLLL 2210       2220       2230       2240       2250
LSVQKRSMSF QGIRQPVTVT ELVDSGILRP STVNELESGQ ISYDEVGERI 2260       2270       2280       2290       2300
KDFLQGSSCI AGIYNETTKQ KLGIYEAMKI GLVRPGTALE LLEAQAATGF 2310       2320       2330       2340       2350
IVDPVSNLRL PVEEAYKRGL VGIEFKEKLL SAERAVTGYN DPETGNIISL 2360       2370       2380       2390       2400
FQAMNKELIE KGHGIRLLEA QIATGGIIDP KESHRLPVDI AYKRGYFNEE 2410       2420       2430       2440       2450
LSEILSDPSD DTKGFFDPNT EENLTYLQLK ERCIKDEETG LCLLPLKEKK 2460       2470       2480       2490       2500
KQVQTSQKNT LRKRRVVIVD PETNKEMSVQ EAYKKGLIDY ETFKELCEQE 2510       2520       2530       2540       2550
CEWEEITITG SDGSTRVVLV DRKTGSQYDI QDAIDKGLVD RKFFDQYRSG 2560       2570       2580       2590       2600
SLSLTQFADM ISLKNGVGTS SSMGSGVSDD VFSSSRHESV SKISTISSVR 2610       2620       2630       2640       2650
NLTIRSSSFS DTLEESSPIA AIFDTENLEK ISITEGIERG IVDSITGQRL 2660       2670       2680       2690       2700
LEAQACTGGI IHPTTGQKLS LQDAVSQGVI DQDMATRLKP AQKAFIGFEG 2710       2720       2730       2740       2750
VKGKKKMSAA EAVKEKWLPY EAGQRFLEFQ YLTGGLVDPE VHGRISTEEA 2760       2770       2780       2790       2800
IRKGFIDGRA AQRLQDTSSY AKILTCPKTK LKISYKDAIN RSMVEDITGL 2810       2820       2830       2840       2850
RLLEAASVSS KGLPSPYNMS SAPGSRSGSR SGSRSGSRSG SRSGSRRGSF 2860       2870
DATGNSSYSY SYSFSSSSIG H
```

Glyceraldehyde-3-Phosphate Dehydrogenase (GAPHD)

```
P04406
                                            (SEQ ID NO: 1194)
         10         20         30         40         50
MGKVKVGVNG FGRIGRLVTR AAFNSGKVDI VAINDPFIDL NYMVYMFQYD 60         70         80         90        100
STHGKFHGTV KAENGKLVIN GNPITIFQER DPSKIKWGDA GAEYVVESTG 110        120        130        140        150
VFTTMEKAGA HLQGGAKRVI ISAPSADAPM FVMGVNHEKY DNSLKIISNA 160        170        180        190        200
SCTTNCLAPL AKVIHDNFGI VEGLMTTVHA ITATQKTVDG PSGKLWRDGR 210        220        230        240        250
GALQNIIPAS TGAAKAVGKV IPELNGKLTG MAFRVPTANV SVVDLTCRLE
```

```
            260         270        280        290        300
KPAKYDDIKK  VVKQASEGPL KGILGYTEHQ VVSSDFNSDT HSSTFDAGAG 310         320        330
IALNDHFVKL  ISWYDNEFGY SNRVVDLMAH MASKE
```

Q2TSD0
```
                                              (SEQ ID NO: 1195)
            10          20         30         40         50
MGKVKVGVNG  FGRIGRLVTR AAFNSGKVDI VAINDPFIDL NYMVYMFQYD 60          70         80         90         100
STHGKFHGTV  KAENGKLVIN GNPITIFQER DPSKIKWGDA GAEYVVESTG 110         120        130        140        150
VFTTMEKAGA  HLQGGAKRVI ISTPSADAPM LVMGVNHEKY DNSLKIISNA 160         170        180        190        200
SCTTNCLAPL  AKVIHDNFGI VEGLMTTVHA ITATQKTVDG PSGKLWRDGR 210         220        230        240        250
GALQNIIPAS  TGAAKAVGKV IPELNGKLTG MAFRVPTANV SVVDLTCRLE 260         270        280        290        300
KPAKYDDIKK  VVKQASEGPL KGILGYTEHQ VVSSDFNSDT HSSTFDAGAG 310         320        330
IALNDHFVKL  ISWYDNEFGY SNRVVDLMAH MASKE
```

Ig Gamma-2 Chain C Region (IGHG2)

P01859
```
                                              (SEQ ID NO: 1196)
            10          20         30         40
ASTKGPSVFP  LAPCSRSTSE STAALGCLVK DYFPEPVTVS 50          60         70         80
WNSGALTSGV  HTFPAVLQSS GLYSLSSVVT VPSSNFGTQT 90          100        110        120
YTCNVDHKPS  NTKVDKTVER KCCVECPPCP APPVAGPSVF 130         140        150        160
LFPPKPKDTL  MISRTPEVTC VVVDVSHEDP EVQFNWYVDG 170         180        190        200
VEVHNAKTKP  REEQFNSTFR VVSVLTVVHQ DWLNGKEYKC 210         220        230        240
KVSNKGLPAP  IEKTISKTKG QPREPQVYTL PPSREEMTKN 250         260        270        280
QVSLTCLVKG  FYPSDISVEW ESNGQPENNY KTTPPMLDSD 290         300        310        320
GSFFLYSKLT  VDKSRWQQGN VFSCSVMHEA LHNHYTQKSL

SLSPGK
```

Myoglobin (MB)

P02144
```
                                              (SEQ ID NO: 1197)
            10          20         30         40
MGLSDGEWQL  VLNVWGKVEA DIPGHGQEVL IRLFKGHPET 50          60         70         80
LEKFDKFKHL  KSEDEMKASE DLKKHGATVL TALGGILKKK 90          100        110        120
GHHEAEIKPL  AQSHATKHKI PVKYLEFISE CIIQVLQSKH 130         140        150
PGDFGADAQG  AMNKALELFR KDMASNYKEL GFQG
```

B2RA67
```
                                              (SEQ ID NO: 1198)
            10          20         30         40
MGLSDGEWQL  VLNVWGKVEA DIPGHGQEVL IRLFKGHPET 50          60         70         80
LERFDKFKHL  KSEDEMKASE DLKKHGATVL TALGGILKKK 90          100        110        120
GHHEAEIKPL  AQSHATKHKI PVKYLEFISE CIIQVLQSKH 130         140        150
PGDFGADAQR  AMNKALELFR KDMASNYKEL GFQG
```

Protein S100-A9 (S100A9)

P06702
```
                                              (SEQ ID NO: 1199)
            10          20         30         40
MTCKMSQLER  NIETIINTFH QYSVKLGHPD TLNQGEFKEL 50          60         70         80
VRKDLQNFLK  KENKNEKVIE HIMEDLDTNA DKQLSFEEFI 90          100        110
MLMARLTWAS  HEKMHEGDEG PGHHHKPGLG EGTP
```

D3DV36
```
                                              (SEQ ID NO: 1200)
            10          20         30         40
MTCKMSQLER  NIETIINTFH QYSVKLGHPD TLNQGEFKEL 50          60         70         80
VRKDLQNFLK  KENKNEKVIE HIMEDLDTNA DKQLSFEEFI 90          100        110
MLMARLTWAS  HEKMHEGDEG PGHHHKPGLG EGTP
```

Semenogelin-1 (SEMG1)

P04279
```
                                              (SEQ ID NO: 1201)
            10          20         30         40
MKPNIIFVLS  LLLILEKQAA VMGQKGGSKG RLPSEFSQFP 50          60         70         80
HGQKGQHYSG  QKGKQQTESK GSFSIQYTYH VDANDHDQSR
```

```
              90        100        110        120
KSQQYDLNAL HKTTKSQRHL GGSQQLLHNK QEGRDHDKSK 130        140        150        160
GHFHRVVIHH KGGKAHRGTQ NPSQDQGNSP SGKGISSQYS 170        180        190        200
NTEERLWVHG LSKEQTSVSG AQKGRKQGGS QSSYVLQTEE 210        220        240        250
LVANKQQRET KNSHQNKGHY QNVVEVREEH SSKVQTSLCP 260        270        280        290
AHQDKLQHGS KDIFSTQDEL LVYNKNQHQT KNLNQDQQHG 300        310        320        330
RKANKISYQS SSTEERRLHY GENGVQKDVS QSSIYSQTEE 340        350        360        370
KAQGKSQKQI TIPSQEQEHS QKANKISYQS SSTEERRLHY 380        390        400        410
GENGVQKDVS QRSIYSQTEK LVAGKSQIQA PNPKQEPWHG 420        430        440        450
ENAKGESGQS TNREQDLLSH EQKGRHQHGS HGGLDIVIIE

460
QEDDSDRHLA QHLNNDRNPL FT
```

Chromogranin-A (CHGA)

```
P10645                                (SEQ ID NO: 1202)
              10        20         30         40
MRSAAVLALL LCAGQVTALP VNSPMNKGDT EVMKCIVEVI 50        60         70         80
SDTLSKPSPM PVSQECFETL RGDERILSIL RHQNLLKELQ 90       100        110        120
DLALQGAKER AHQQKKHSGF EDELSEVLEN QSSQAELKEA 130       140        150        160
VEEPSSKDVM EKREDSKEAE KSGEATDGAR PQALPEPMQE 170       180        190        200
SKAEGNNQAP GEEEEEEEEA TNTHPPASLP SQKYPGPQAE 210       220        230        240
GDSEGLSQGL VDREKGLSAE PGWQAKREEE EEEEEEAEAG 250       260        270        280
EEAVPEEEGP TVVLNPHPSL GYKEIRKGES RSEALAVDGA 290       300        310        320
GKPGAEEAQD PEGKGEQEHS QQKEEEEEMA VVPQGLFRGG 330       340        350        360
KSGELEQEEE RLSKEWEDSK RWSKMDQLAK ELTAEKRLEG 370       380        390        400
QEEEEDNRDS SMKLSFRARA YGFRGPGPQL RRGWRPSSRE 410       420        430        440
DSLEAGLPLQ VRGYPEEKKE EEGSANRRPE DQELESLSAI

450
EAELEKVAHQ LQALRRG
```

Histone H4 (HIST1H4A includes others)

```
P62805                                (SEQ ID NO: 1203)
              10        20         30         40
MSGRGKGGKG LGKGGAKRHR KVLRDNIQGI TKPAIRRLAR 50        60         70         80
RGGVKRISGL IYEETRGVLK VFLENVIRDA VTYTEHAKRK 90       100
TVTAMDVVYA LKRQGRTLYG FGG

B2R4R0                                (SEQ ID NO: 1204)
              10        20         30         40
MSGRGKGGKG LGKGGAKRHR KVLRDNIQGI TKPAIRRLAR 50        60         70         80
RGGVKRISGL IYEETRGVLK VFLENVIRDA VTYTEHAKRK 90       100
TVTAMDVVYA LKRQGRTLYG FGG

Q0VAS5                                (SEQ ID NO: 1205)
              10        20         30         40
MSGRGKGGKG LGKGGAKRHR KVLRDNIQGI TKPAIRRLAR 50        60         70         80
RGGVKRISGL IYEETRGVLK VFLENVIRDA VTYTEHAKCK 90       100
TVTAMDVVYA LKRQGRTLYG FGG
```

Histone H1.4 (HIST1H1E)

```
P10412                                (SEQ ID NO: 1206)
              10        20         30         40         50
MSETAPAAPA APAPAEKTPV KKKARKSAGA AKRKASGPPV SELITKAVAA 60        70         80         90        100
SKERSGVSLA ALKKALAAAG YDVEKNNSRI KLGLKSLVSK GTLVQTKGTG 110       120        130        140        150
ASGSFKLNKK AASGEAKPKA KKAGAAKAKK PAGAAKKPKK ATGAATPKKS 160       170        180        190        200
AKKTPKKAKK PAAAAGAKKA KSPKKAKAAK PKKAPKSPAK AKAVKPKAAK

210
PKTAKPKAAK PKKAAAKKK

P16402                                (SEQ ID NO: 1207)
              10        20         30         40         50
MSETAPLAPT IPAPAEKTPV KKKAKKAGAT AGKRKASGPP VSELITKAVA 60        70         80         90        100
```

```
                                           -continued
ASKERSGVSL AALKKALAAA GYDVEKNNSR IKLGLKSLVS KGTLVQTKGT 110        120        130        140        150
GASGSFKLNK KAASGEGKPK AKKAGAAKPR KPAGAAKKPK KVAGAATPKK 160        170        180        190        200
SIKKTPKKVK KPATAAGTKK VAKSAKKVKT PQPKKAAKSP AKAKAPKPKA 210        220
AKPKSGKPKV TKAKKAAPKK K P16403
                                                    (SEQ ID NO: 1208)
         10         20         30         40         50
MSETAPAAPA AAPPAEKAPV KKKAAKKAGG TPRKASGPPV SELITKAVAA 60         70         80         90        100
SKERSGVSLA ALKKALAAAG YDVEKNNSRI KLGLKSLVSK GTLVQTKGTG 110        120        130        140        150
ASGSFKLNKK AASGEAKPKV KKAGGTKPKK PVGAAKKPKK AAGGATPKKS 160        170        180        190        200
AKKTPKKAKK PAAATVTKKV AKSPKKAKVA KPKKAAKSAA KAVKPKAAKP

210
KVVKPKKAAP KKK

A3R0T7
                                                    (SEQ ID NO: 1209)
         10         20         30         40         50
MSETAPAAPA APAPAEKTPV KKKARKSAGA AKRKASGPPV SELITKAVTA 60         70         80         90        100
SKERSGVSLA ALKKALAAAG YDVEKNNSRI KLGLKSLVSK GTPVQTKGTG 110        120        130        140        150
ASGSFKLNKK AASGEAKPKA KKAGAAKAKK PAGAAKKPKK ATGAATPKKS 160        170        180        190        200
AKKTPKKAKK PAAAGAKKA KSPKKAKAAK PKKAPKSPAK AKAVKPKAAK

210
PKTAKPKAAK PKKAAAKKK

A3R0T8
                                                    (SEQ ID NO: 1210)
         10         20         30         40         50
MSETAPAAPA APAPAEKTPV KKKARKSAGA AKRKASGPPV SELITKAVAA 60         70         80         90        100
SKERSGVSLA ALKKALAAAG YDVEKNNSRI KLGLKSLVSK GTLVQTKGTG 110        120        130        140        150
ASGSFKLNKK AASGEAKPKA KKAGAAKAKK PAGAAKKPKK ATGAATPKKS 160        170        180        190        200
AKKTPKKAKK PAAAGAKKA KSPKKAKAAK PKKAPKSPAK AKAVKPKAAK

210
PKTAKPKAAK PKKAAAKKK

A8K4I2
                                                    (SEQ ID NO: 1211)
         10         20         30         40         50
MSETAPAAPA AAPPAEKAPV KKKAAKKAGG TPRKASGPPV SELITKAVAA 60         70         80         90        100
SKERSGVSLA ALKKALAAAG YDVEKNNSRI KLGLKSLVSK GTLVQTKGTG 110        120        130        140        150
ASGSFKLNKK AASGEAKPKV KKAGGTKPKK PVGAAKKPKK AAGGATPKKS 160        170        180        190        200
AKKTPKKAKK PAAATVTKKV AKSPKKAKVA KPKKAAKSAA KAVKPKAAKP

210
KVVKPKKAAP KKK

B2R984
```

```
                                          (SEQ ID NO: 1212)
         10         20         30         40         50
MSETAPAAPA APAPAEKTPV KKKARKSAGA AKRKASGPPV SELITKAVAA 60         70         80         90        100
SKERSGVSLA ALKKALAAAG YDVEKNNSRI KLGLKSLVSK GTLVQTKGTG 110        120        130        140        150
ASGSFKLNKK AASGEAKPKA KKAGAAKAKK PAGAAKKPKK VTGAATPKKS 160        170        180        190        200
AKKTPKKAKK PAAAAGAKKA KSPKKAKAAK PKKAPKSPAK AKAVKPKAAK

210
PKTAKPKAAK PKKAAAKKK

Q4VB24
                                          (SEQ ID NO: 1213)
         10         20         30         40         50
MSETAPAAPA APAPAEKTPV KKKARKSAGA AKRKASGPPV SELITKVVAA 60         70         80         90        100
SKERSGVSLA ALKKALAAAG YDVEKNNSRI KLGLKSLVSK GTLVQTKGTG 110        120        130        140        150
ASGSFKLNKK AASGEAKPKA KKAGAAKAKK PAGAAKKPKK ATGAATPKKS 160        170        180        190        200
AKKTPKKAKK PAAAAGAKKA KSPKKAKAAK PKKAPKSPAK AKAVKPKAAK

210
PKTAKPKAAK PKKAAAKKK
```

Protein S100-A7(S100A7)

```
P31151
                                          (SEQ ID NO: 1214)
         10         20         30         40
MSNTQAERSI IGMIDMFHKY TRRDDKIEKP SLLTMMKENF 50         60         70         80
PNFLSACDKK GTNYLADVFE KKDKNEDKKI DFSEFLSLLG 90        100
DIATDYHKQS HGAAPCSGGS Q
```

Apolipoprotein A-II (APOA2)

```
P02652
                                          (SEQ ID NO: 1215)
         10         20         30         40
MKLLAATVLL LTICSLEGAL VRRQAKEPCV ESLVSQYFQT 50         60         70         80
VTDYGKDLME KVKSPELQAE AKSYFEKSKE QLTPLIKKAG 90        100
TELVNFLSYF VELGTQPATQ
```

Carbonic anhydrase 1 (CA1)

```
P00915
                                          (SEQ ID NO: 1216)
         10         20         30         40
MASPDWGYDD KNGPEQWSKL YPIANGNNQS PVDIKTSETK 50         60         70         80
HDTSLKPISV SYNPATAKEI INVGHSFHVN FEDNDNRSVL 90        100        110        120
KGGPFSDSYR LFQFHFHWGS TNEHGSEHTV DGVKYSAELH 130        140        150        160
VAHWNSAKYS SLAEAASKAD GLAVIGVLMK VGEANPKLQK 170        180        190        200
VLDALQAIKT KGKRAPFTNF DPSTLLPSSL DFWTYPGSLT 210        220        230        240
HPPLYESVTW IICKESISVS SEQLAQFRSL LSNVEGDNAV 250        260
PMQHNNRPTQ PLKGRTVRAS F
```

Lactoferrin (LTF)

```
Q2TUW9
                                          (SEQ ID NO: 1217)
         10         20         30         40
MKLVFLVLLF LGALGLCLAG RRRGSVQWCA VSQPEATKCF 50         60         70         80
QWQRNMRRVR GPPVSCIKRD SPIQCIQAIA ENRADAVTLD 90        100        110        120
GGFIYEAGLA PYKLRPVAAE VYGTERQPRT HYYAVAVVKK 130        140        150        160
GGSFQLNELQ GLKSCHTGLR RTAGWNVPIG TLRPFLNWTG 170        180        190        200
PPEPIEAAVA RFFSASCVPG ADKGQFPNLC RLCAGTGENK 210        220        230        240
CAFSSQEPYF SYSGAFKCLR DGAGDVAFIR ESTVFEDLSD 250        260        270        280
EAERDEYELL CPDNTRKPVD KFKDCHLARV PSHAVVARSV 290        300        310        320
NGKEDAIWNL LRQAQEKFGK DKSPKFQLFG SPSGQKDLLF 330        340        350        360
KDSAIGSSRV PPRIDSGLYL GSGYFTAIQN LRKSEEEVAA 370        380        390        400
RRARVVWCAV GEQELRKCNQ WSGLSEGSVT CSSASTTEDC 410        420        430        440
```

```
            -continued
IALKGEADAM SLDGGYVYTA GKCGLVPVLA ENYKSQQSSD 450        460        470        480
PDPNCVDRPV EGYLAVAVVR RSDTSLTWNS VKGKKSCHTA 490        500        510        520
VDRTAGWNIP MGLLFNQTGS CKFDEYFSQS CAPGSDPRSN 530        540        550        560
LCALCIGDEQ GENKCVPNSN ERYYGYTGAF RCLAENAGDV 570        580        590        600
AFVKDVTVLQ NTDGNNNDAW AKDLKLADFA LLCLDGKRKP 610        620        630        640
VTEARSCHLA MAPNHAVVSR MDKVERLKQV LLHQQAKFGR 650        660        670        680
NGSDCPDKFC LFQSETKNLL FNDNTECLAR LHGKTTYEKY 690        700
LGPQYVAGIT NLKKCSTSPL LEACEFLRK
```

Insulin-Like Growth Factor-Binding Protein 1 (IGFBP1 Includes EC: 16006)

```
P08833
                                 (SEQ ID NO: 1218)
         10         20         30         40
MSEVPVARVW LVLLLLTVQV GVTAGAPWQC APCSAEKLAL 50         60         70         80
CPPVSASCSE VTRSAGCGCC PMCALPLGAA CGVATARCAR 90        100        110        120
GLSCRALPGE QQPLHALTRG QGACVQESDA SAPHAAEAGS 130        140        150        160
PESPESTEIT EEELLDNFHL MAPSEEDHSI LWDAISTYDG 170        180        190        200
SKALHVTNIK KWKEPCRIEL YRVVESLAKA QETSGEEISK 210        220        230        240
FYLPNCNKNG FYHSRQCETS MDGEAGLCWC VYPWNGKRIP

250
GSPEIRGDPN CQIYFNVQN

C1K3N3
                                 (SEQ ID NO: 1219)
         10         20         30         40
SEVPVARVWL VLLLLTVQVG VTAGAPWQCA PCSAEKLALC 50         60         70         80
PPVSASCSEV TRSAGCGCCP MCALPLGAAC GVATARCARG 90        100        110        120
LSCRALPGEQ QPLHALTRGQ GACVQESDAS APHAAEAGSP 130        140        150        160
ESPESTEITE EELLDNFHLM APSEEDHSIL WDAISTYDGS 170        180        190        200
KALHVTNIKK WKEPCRIELY RVVESLAKAQ ETSGEEISKF 210        220        230        240
YLPNCNKNGF YHSRQCETSM DGEAGLCWCV YPWNGKRIPG

250
SPEIRGDPNC QIYFNVQN

C9JXF9
                                 (SEQ ID NO: 1220)
         10         20         30         40
MSEVPVARVW LVLLLLTVQV GVTAGAPWQC APCSAEKLAL 50         60         70         80
CPPVSASCSE VTRSAGCGCC PMCALPLGAA CGVATARCAR 90        100        110        120
GLSCRALPGE QQPLHALTRG QGACVQESDA SAPHAAEAGS 130        140        150        160
PESPESTEIT EEELLDNFHL MAPSEEDHSI LWDAISTYDG 170        180        190        200
SKALHVTNIK KWKEPCRIEL YRVVESLAKA QETSGEEISK 210        220        230        240
FYLPNCNKNG FYHSRQTSMD GEAGLCWCVY PWNGKRIPGS

250
PEIRGDPNCQ IYFNVQN

D3DVL9
                                 (SEQ ID NO: 1221)
         10         20         30         40
MSEVPVARVW LVLLLLTVQV GVTAGAPWQC APCSAEKLAL 50         60         70         80
CPPVSASCSE VTRSAGCGCC PMCALPLGAA CGVATARCAR 90        100        110        120
GLSCRALPGE QQPLHALTRG QGACVQESDA SAPHAAEAGS 130        140        150        160
PESPESTEIT EEELLDNFHL MAPSEEDHSI LWDAISTYDG 170        180        190        200
SKALHVTNIK KWKEPCRIEL YRVVESLAKA QETSGEEISK 210        220        230        240
FYLPNCNKNG FYHSRQCETS MDGEAGLCWC VYPWNGKRIP

250
GSPEIRGDPN CQIYFNVQN

Q6PEY6
                                 (SEQ ID NO: 1222)
         10         20         30         40
MSEVPVARVW LVLLLLTVQV GVTAGAPWQC APCSAEKLAL 50         60         70         80
CPPVSASCSE VTRSAGCGCC PMCALPLGAA CGVATARCAR 90        100        110        120
GLSCRALPGE QQPLHALTRG QGACVQESDA SAPHAAEAGS 130        140        150        160
PESPESTEIT EEELLDNFHL MAPSEEDHSI PWDAISTYDG 170        180        190        200
SKALHVTNIK KWKEPCRIEL YRVVESLAKA QETSGEEISK 210        220        230        240
FYLPNCNKNG FYHSRQCETS MDGEAGLCWC VYPWNGKRIP

250
GSPEIRGDPN CQIYFNVQN
``` cDNA FLJ75188, Highly Similar to *Homo sapiens* Matrillin 2, Transcript Variant 2, mRNA (MATN2)

```
A8K106
                                 (SEQ ID NO: 1223)
         10         20         30         40
MEKMLAGCFL LILGQIVLLP AEARERSRGR SISRGRHART 50         60         70         80
HPQTALLESS CENKRADLVF IIDSSRSVNT HDYAKVKEFI 90        100        110        120
VDILQFLDIG PDVTRVGLLQ YGSTVKNEFS LKTFKRKSEV 130        140        150        160
ERAVKRMRHL STGTMTGLAI QYALNIAFSE AEGARPLREN
```

```
                170         180         190         200
         VPRVIMIVTD GRPQDSVAEV AAKARDTGIL IFAIGVGQVD 210         220         230         240
         FNTLKSIGSE PHEDHVFLVA NFSQIETLTS VFQKKLCTAH 250         260         270         280
         MCSTLEHNCA HFCINIPGSY VCRCKQGYIL NSDQTTCRIQ 290         300         310         320
         DLCAMEDHNC EQLCVNVPGS FVCQCYSGYA LAEDGKRCVA 330         340         350         360
         VDYCASENHG CEHECVNADG SYLCQCHEGF ALNPDKKTCT 370         380         390         400
         KIDYCASSNH GCQHECVNTD DSYCHCLKG FTLNPDKKTC 410         420         430         440
         RRINYCALNK PGCEHECVNM EESYYCRCHR GYTLDPNGKT 450         460         470         480
         CSRVDHCAQQ DHGCEQLCLN TEDSFVCQCS EGFLINEDLK 490         500         510         520
         TCSRVDYCLL SDHGCEYSCV NMDRSFACQC PEGHVLRSDG 530         540         550         560
         KTCAKLDSCA LGDHGCEHSC VSSEDSFVCQ CFEGYILRED 570         580         590         600
         GKTCRRKDVC QAIDHGCEHI CVNSDDSYTC ECLEGFRLAE 610         620         630         640
         DGKRCRRKDV CKSTHHGCEH ICVNNGNSYI CKCSEGFVLA 650         660         670         680
         EDGRRCKKCT EGPIDLVFVI DGSKSLGEEN FEVVKQFVTG 690         700         710         720
         IIDSLTISPK AARVGLLQYS TQVHTEFTLR NFNSAKDMKK 730         740         750         760
         AVAHMKYMGK GSMTGLALKH MFERSFTQGE GARPLSTRVP 770         780         790         800
         RAAIVFTDGR AQDDVSEWAS KAKANGITMY AVGVGKAIEE 810         820         830         840
         ELQEIASEPT NKHLFYAEDF STMDEISEKL KKGICEALED 850         860         870         880
         SDGRQDSPAG ELPKTVQQPT ESEPVTINIQ DLLSCSNFAV 890         900         910         920
         QHRYLFEEDN LLRSTQKLSH STKPSGSPLE EKHDQCKCEN 930         940         950
         LIMFQNLANE EVRKLTQRLE EMTQRMEALE NRLRYR
```

Peroxiredoxin-2 (PRDX2)

```
         P32119
                                              (SEQ ID NO: 1224)
                 10         20         30         40
         MASGNARIGK PAPDFKATAV VDGAFKEVKL SDYKGKYVVL 50         60         70         80
         FFYPLDFTFV CPTEIIAFSN RAEDFRKLGC EVLGVSVDSQ 90        100        110        120
         FTHLAWINTP RKEGGLGPLN IPLLADVTRR LSEDYGVLKT 130        140        150        160
         DEGIAYRGLF IIDGKGVLRQ ITVNDLPVGR SVDEALRLVQ 170        180        190
         AFQYTDEHGE VCPAGWKPGS DTIKPNVDDS KEYFSKHN
```

```
         B4DF70
                                              (SEQ ID NO: 1225)
                 10         20         30         40
         MASGNARIGK PAPDFKATAV VDGAFKEVKL SDYKGKYVVL 50         60         70         80
         FFYPLDFTFV CPTEIIAFSN RAEDFRKLGC EVLGVSVDSQ 90        100        110        120
         FTHLAWINTP RKEGGLGPLN IPLLADVTRR LSEDYGVLKT 130        140        150        160
         DEGIAYRGLF IIDGKGVLRQ ITVNDLPVGR SVDEALRLAV 170        180
         TRLSPTWMTA RNISPNTIRL ANG
```

Extracellular Matrix Protein 1 (ECM1)

```
         Q16610
                                              (SEQ ID NO: 1226)
                 10         20         30         40
         MGTTARAALV LTYLAVASAA SEGGFTATGQ RQLRPEHFQE 50         60         70         80
         VGYAAPPSPP LSRSLPMDHP DSSQHGPPFE GQSQVQPPPS 90        100        110        120
         QEATPLQQEK LLPAQLPAEK EVGPPLPQEA VPLQKELPSL 130        140        150        160
         QHPNEQKEGT PAPFGDQSHP EPESWNAAQH CQQDRSQGGW 170        180        190        200
         GHRLDGFPPG RPSPDNLNQI CLPNRQHVVY GPWNLPQSSY 210        220        230        240
         SHLTRQGETL NFLEIGYSRC CHCRSHTNRL ECAKLVWEEA 250        260        270        280
         MSRFCEAEFS VKTRPHWCCT RQGEARFSCF QEEAPQPHYQ 290        300        310        320
         LRACPSHQPD ISSGLELPFP PGVPTLDNIK NICHLRRFRS 330        340        350        360
         VPRNLPATDP LQRELLALIQ LEREFQRCCR QGNNHTCTWK 370        380        390        400
         AWEDTLDKYC DREYAVKTHH HLCCRHPPSP TRDECFARRA 410        420        430        440
         PYPNYDRDIL TIDIGRVTPN LMGHLCGNQR VLTKHKHIPG 450        460        470        480
         LIHNMTARCC DLPFPEQACC AEEEKLTFIN DLCGPRRNIW 490        500        510        520
         RDPALCCYLS PGDEQVNCFN INYLRNVALV SGDTENAKGQ 530        540
         GEQGSTGGTN ISSTSEPKEE
```

Intracellular Adhesion Molecule 1 (ICAM1)

```
         P05362
                                              (SEQ ID NO: 1227)
                 10         20         30         40
         MAPSSPRPAL PALLVLLGAL FPGPGNAQTS VSPSKVILPR 50         60         70         80
         GGSVLVTCST SCDQPKLLGI ETPLPKKELL LPGNNRKVYE 90        100        110        120
         LSNVQEDSQP MCYSNCPDGQ STAKTFLTVY WTPERVELAP 130        140        150        160
         LPSWQPVGKN LTLRCQVEGG APRANLTVVL LRGEKELKRE
```

-continued

```
           170         180         190         200
    PAVGEPAEVT  TTVLVRRDHH  GANFSCRTEL  DLRPQGLELF 210         220         230         240
    ENTSAPYQLQ  TFVLPATPPQ  LVSPRVLEVD  TQGTVVCSLD 250         260         270         280
    GLFPVSEAQV  HLALGDQRLN  PTVTYGNDSF  SAKASVSVTA 290         300         310         320
    EDEGTQRLTC  AVILGNQSQE  TLQTVTIYSF  PAPNVILTKP 330         340         350         360
    EVSEGTEVTV  KCEAHPRAKV  TLNGVPAQPL  GPRAQLLLKA 370         380         390         400
    TPEDNGRSFS  CSATLEVAGQ  LIHKNQTREL  RVLYGPRLDE 410         420         430         440
    RDCPGNWTWP  ENSQQTPMCQ  AWGNPLPELK  CLKDGTFPLP 450         460         470         480
    IGESVTVTRD  LEGTYLCRAR  STQGEVTRKV  TVNVLSPRYE 490         500         510         520
    IVIITVVAAA  VIMGTAGLST  YLYNRQRKIK  KYRLQQAQKG

530
    TPMKPNTQAT  PP
```

Interleukin-2 (L2)

```
    P60568
                                      (SEQ ID NO: 1228)
            10          20          30          40
    MYRMQLLSCI  ALSLALVTNS  APTSSSTKKT  QLQLEHLLLD 50          60          70          80
    LQMILNGINN  YKNPKLTRML  TFKFYMPKKA  TELKHLQCLE 90         100         110         120
    EELKPLEEVL  NLAQSKNFHL  RPRDLISNIN  VIVLELKGSE 130         140         150
    TTFMCEYADE  TATIVEFLNR  WITFCQSIIS  TLT
```

Lumican (LUM)

```
    P51884
                                      (SEQ ID NO: 1229)
            10          20          30          40
    MSLSAFTLFL  ALIGGTSGQY  YDYDFPLSIY  GQSSPNCAPE 50          60          70          80
    CNCPESYPSA  MYCDELKLKS  VPMVPPGIKY  LYLRNNQIDH 90         100         110         120
    IDEKAFENVT  DLQWLILDHN  LLENSKIKGR  VFSKLKQLKK 130         140         150         160
    LHINHNNLTE  SVGPLPKSLE  DLQLTHNKIT  KLGSFEGLVN 170         180         190         200
    LTFIHLQHNR  LKEDAVSAAF  KGLKSLEYLD  LSFNQIARLP 210         220         230         240
    SGLPVSLLTL  YLDNNKISNI  PDEYFKRFNA  LQYLRLSHNE 250         260         270         280
    LADSGIPGNS  FNVSSLVELD  LSYNKLKNIP  TVNENLENYY 290         300         310         320
    LEVNQLEKFD  IKSFCKILGP  LSYSKIKHLR  LDGNRISETS

330
    LPPDMYECLR  VANEVTLN
```

Natriuretic Peptide B (NPPB)

```
    P16860
                                      (SEQ ID NO: 1230)
            10          20          30          40
    MDPQTAPSRA  LLLLLFLHLA  FLGGRSHPLG  SPGSASDLET 50          60          70          80
    SGLQEQRNHL  QGKLSELQVE  QTSLEPLQES  PRPTGVWKSR 90         100         110         120
    EVATEGIRGH  RKMVLYTLRA  PRSPKMVQGS  GCFGRKMDRI

130
    SSSSGLGCKV  LRRH
```

Serum Amyloid A-1 protein (SAA1)

```
    P0DJI8
                                      (SEQ ID NO: 1231)
            10          20          30          40
    MKLLTGLVFC  SLVLGVSSRS  FFSFLGEAFD  GARDMWRAYS 50          60          70          80
    DMREANYIGS  DKYFHARGNY  DAAKRGPGGV  WAAEAISDAR 90         100         110         120
    ENIQRFFGHG  AEDSLADQAA  NEWGRSGKDP  NHFRPAGLPE  KY
```

Angiogenin (ANG)

```
    P03950
                                      (SEQ ID NO: 1232)
            10          20          30          40
    MVMGLGVLLL  VFVLGLGLTP  PTLAQDNSRY  THFLTQHYDA 60          70          80
    KPQGRDDRYC  ESIMRRRGLT  SPCKDINTFI  HGNKRSIKAI 90         100         110         120
    CENKNGNPHR  ENLRISKSSF  QVTTCKLHGG  SPWPPCQYRA 130         140
    TAGFRNVVVA  CENGLPVHLD  QSIFRRP
```

Extracellular Matrix Protein for Lone Palate Lune and Nasal Epithelium Carcinoma-1 (LPLUNC1)

```
    Q8TDL5
                                      (SEQ ID NO: 1233)
    MAGPWTFTLL  CGLLAATLIQ  ATLSPTAVLI  LGPKVIKEKL 60          70          80
    TQELKDHNAT  SILQQLPLLS  AMREKPAGGI  PVLGSLVNTV 90         100         110         120
    LKHIIWLKVI  TANILQLQVK  PSANDQELLV  KIPLDMVAGF 130         140         150         160
    NTPLVKTIVE  FHMTTEAQAT  IPMDTSASGP  TRLVLSDCAT 170         180         190         200
    SHGSLRIQLL  HKLSFLVNAL  AKQVMNLLVP  SLPNLVKNQL 210         220         230         240
    CPVIEASFNG  MYADLLQLVK  VPISLSIDRL  EFDLLYPAIK 250         260         270         280
    GDTIQLYLGA  KLLDSQGKVT  KWFNNSAASL  TMPTLDNIPF 290         300         310         320
    SLIVSQDVVK  AAVAAVLSPE  EFMVLLDSVL  PESAHRLKSS 330         340         350         360
    IGLINEKAAD  KLGSTQIVKI  LTQDTPEFFI  DQGHAKVAQL
```

-continued

```
          370         380         390         400
     IVLEVFPSSE  ALRPLFTLGI  EASSEAQFYT  KGDQLILNLN 410         420         430         440
     NISSDRIQLM  NSGIGWFQPD  VLKNIITEII  HSILLPNQNG 450         460         470         480
     KLRSGVPVSL  VKALGFEAAE  SSLTKDALVL  TPASLWKPSS  PVSQ
```

Thioredoxin

```
     P10599
                                              (SEQ ID NO: 1234)
           10          20          30          40
     MVKQIESKTA  FQEALDAAGD  KLVVVDFSAT  WCGPCKMIKP 50          60          70          80
     FFHSLSEKYS  NVIFLEVDVD  DCQDVASECE  VKCMPTFQFF
```

-continued

```
           90         100
     KKGQKVGEFS  GANKEKLEAT  INELV
```

SH3 Domain-Binding Glutamic Acid-Rich-Like Protein (SH3, SH3L1)

```
     O75368
                                              (SEQ ID NO: 1235)
           10          20          30          40
     MVIRVYIASS  SGSTAIKKKQ  QDVLGFLEAN  KIGFEEKDIA 50          60          70          80
     ANEENRKWMR  ENVPENSRPA  TGYPLPPQIF  NESQYRGDYD 90         100         110
     AFFEARENNA  VYAFLGLTAP  PGSKEAEVQA  KQQA
```

SEQUENCE LISTING (1349 sequences)

SEQ ID NO: 1 - protein, 14 aa, Artificial Sequence
  Description of Artificial Sequence: Synthetic peptide
ESISVSSEQLAQFR

SEQ ID NO: 2 - protein, 25 aa, Artificial Sequence
  Description of Artificial Sequence: Synthetic peptide
SLLSNVEGDNAVPMQHNNRPTQPLK

SEQ ID NO: 3 - protein, 16 aa, Artificial Sequence
  Description of Artificial Sequence: Synthetic peptide
NAIHTFVQSGSHLAAR

SEQ ID NO: 4 - protein, 11 aa, Artificial Sequence
  Description of Artificial Sequence: Synthetic peptide
HMNGYGSHTFK

SEQ ID NO: 5 - protein, 14 aa, Artificial Sequence
  Description of Artificial Sequence: Synthetic peptide
YPPTVSMVEGQGEK

SEQ ID NO: 6 - protein, 30 aa, Artificial Sequence
  Description of Artificial Sequence: Synthetic polypeptide
IGLVRPGTALELLEAQAATGFIVDPVSNLR

SEQ ID NO: 7 - protein, 9 aa, Artificial Sequence
  Description of Artificial Sequence: Synthetic peptide
DILTIDIGR

SEQ ID NO: 8 - protein, 9 aa, Artificial Sequence
  Description of Artificial Sequence: Synthetic peptide
LVWEEAMSR

SEQ ID NO: 9 - protein, 10 aa, Artificial Sequence
  Description of Artificial Sequence: Synthetic peptide
NLPATDPLQR

SEQ ID NO: 10 - protein, 14 aa, Artificial Sequence
  Description of Artificial Sequence: Synthetic peptide
QGETLNFLEIGYSR

SEQ ID NO: 11 - protein, 20 aa, Artificial Sequence
  Description of Artificial Sequence: Synthetic peptide
QHVVYGPWNLPQSSYSHLTR

SEQ ID NO: 12 - protein, 20 aa, Artificial Sequence
  Description of Artificial Sequence: Synthetic peptide
QHVVYGPWNLPQSSYSHLTR

SEQ ID NO: 13 - protein, 19 aa, Artificial Sequence
  Description of Artificial Sequence: Synthetic peptide
IDSGLYLGSGYFTAIQNLR

SEQ ID NO: 14 - protein, 9 aa, Artificial Sequence
  Description of Artificial Sequence: Synthetic peptide
VPSHAVVAR

SEQ ID NO: 15 - protein, 11 aa, Artificial Sequence
  Description of Artificial Sequence: Synthetic peptide
SDTSLTWNSVK

SEQ ID NO: 16 - protein, 8 aa, Artificial Sequence
  Description of Artificial Sequence: Synthetic peptide
FNALQYLR

SEQ ID NO: 17 - protein, 8 aa, Artificial Sequence
  Description of Artificial Sequence: Synthetic peptide
FNALQYLR

SEQ ID NO: 18 - protein, 14 aa, Artificial Sequence
  Description of Artificial Sequence: Synthetic peptide
SLEYLDLSFNQIAR

SEQ ID NO: 19 - protein, 20 aa, Artificial Sequence
  Description of Artificial Sequence: Synthetic peptide
IEDMAMLTFLHEPAVLYNLK

SEQ ID NO: 20 - protein, 17 aa, Artificial Sequence
  Description of Artificial Sequence: Synthetic peptide
EGGLGPLNIPLLADVTR

SEQ ID NO: 21 - protein, 10 aa, Artificial Sequence
  Description of Artificial Sequence: Synthetic peptide
RLSEDYGVLK

SEQ ID NO: 22 - protein, 8 aa, Artificial Sequence
  Description of Artificial Sequence: Synthetic peptide
TDEGIAYR

SEQ ID NO: 23 - protein, 11 aa, Artificial Sequence
  Description of Artificial Sequence: Synthetic peptide
SIIGMIDMFHK

SEQ ID NO: 24 - protein, 11 aa, Artificial Sequence
  Description of Artificial Sequence: Synthetic peptide
SIIGMIDMFHK

SEQ ID NO: 25 - protein, 13 aa, Artificial Sequence
  Description of Artificial Sequence: Synthetic peptide
QSHGAAPCSGGSQ

SEQ ID NO: 26 - protein, 13 aa, Artificial Sequence
  Description of Artificial Sequence: Synthetic peptide
QLSFEEFIMLMAR

SEQ ID NO: 27 - protein, 20 aa, Artificial Sequence
  Description of Artificial Sequence: Synthetic peptide
FFGHGAEDSLADQAANEWGR

SEQ ID NO: 28 - protein, 15 aa, Artificial Sequence
  Description of Artificial Sequence: Synthetic peptide
GPGGVWAAEAISDAR

SEQ ID NO: 29 - protein, 10 aa, Artificial Sequence
  Description of Artificial Sequence: Synthetic peptide
HLAQHLNNDR

SEQ ID NO: 30 - protein, 16 aa, Artificial Sequence
  Description of Artificial Sequence: Synthetic peptide
HLGGSQQLLHNKQEGR

SEQ ID NO: 31 - protein, 9 aa, Artificial Sequence
  Description of Artificial Sequence: Synthetic peptide
GESGQSTNR

SEQ ID NO: 32 - protein, 16 aa, Artificial Sequence
  Description of Artificial Sequence: Synthetic peptide
DLMEKVKSPELQAEAK

SEQ ID NO: 33 - protein, 25 aa, Artificial Sequence
  Description of Artificial Sequence: Synthetic peptide
EPCVESLVSQYFQTVTDYGKDLMEK

SEQ ID NO: 34 - protein, 28 aa, Artificial Sequence
  Description of Artificial Sequence: Synthetic peptide
QAKEPCVESLVSQYFQTVTDYGKDLMEK

SEQ ID NO: 35 - protein, 20 aa, Artificial Sequence
  Description of Artificial Sequence: Synthetic peptide
EPCVESLVSQYFQTVTDYGK

SEQ ID NO: 36 - protein, 9 aa, Artificial Sequence
  Description of Artificial Sequence: Synthetic peptide
EQLTPLIKK

SEQ ID NO: 37 - protein, 12 aa, Artificial Sequence
  Description of Artificial Sequence: Synthetic peptide
EHVKPLFNMEDK

SEQ ID NO: 38 - protein, 12 aa, Artificial Sequence
  Description of Artificial Sequence: Synthetic peptide
EHVKPLFNMEDK

SEQ ID NO: 39 - protein, 16 aa, Artificial Sequence
  Description of Artificial Sequence: Synthetic peptide
GEISATQDVMMEEIFR

SEQ ID NO: 40 - protein, 16 aa, Artificial Sequence
  Description of Artificial Sequence: Synthetic peptide
GEISATQDVMMEEIFR

SEQ ID NO: 41 - protein, 20 aa, Artificial Sequence
  Description of Artificial Sequence: Synthetic peptide
LGLSDMNLYDHELVFGVSLK

SEQ ID NO: 42 - protein, 25 aa, Artificial Sequence
  Description of Artificial Sequence: Synthetic peptide
LVQFLLMNPANDGGQWDMLVNIVEK

SEQ ID NO: 43 - protein, 32 aa, Artificial Sequence
  Description of Artificial Sequence: Synthetic polypeptide
LVQFLLMNPANDGGQWDMLVNIVEKYGVIPKK

SEQ ID NO: 44 - protein, 14 aa, Artificial Sequence
  Description of Artificial Sequence: Synthetic peptide
LYTVEYLSNMVGGR

SEQ ID NO: 45 - protein, 15 aa, Artificial Sequence
  Description of Artificial Sequence: Synthetic peptide
LYTVEYLSNMVGGRK

SEQ ID NO: 46 - protein, 19 aa, Artificial Sequence
  Description of Artificial Sequence: Synthetic peptide
EIINVGHSFHVNFEDNDNR

SEQ ID NO: 47 - protein, 12 aa, Artificial Sequence
  Description of Artificial Sequence: Synthetic peptide
ADGLAVIGVLMK

SEQ ID NO: 48 - protein, 11 aa, Artificial Sequence
  Description of Artificial Sequence: Synthetic peptide
MASPDWGYDDK

SEQ ID NO: 49 - protein, 14 aa, Artificial Sequence
  Description of Artificial Sequence: Synthetic peptide
MTKMLHVAHWNSAK

SEQ ID NO: 50 - protein, 14 aa, Artificial Sequence
  Description of Artificial Sequence: Synthetic peptide
MTKMLHVAHWNSAK

SEQ ID NO: 51 - protein, 25 aa, Artificial Sequence
  Description of Artificial Sequence: Synthetic peptide
SLLSNVEGDNAVPMQHNNRPTQPLK

SEQ ID NO: 52 - protein, 19 aa, Artificial Sequence
  Description of Artificial Sequence: Synthetic peptide
ETVCPRTTQQSPEDCDFKK

SEQ ID NO: 53 - protein, 18 aa, Artificial Sequence
  Description of Artificial Sequence: Synthetic peptide
ETVCPRTTQQSPEDCDFK

SEQ ID NO: 54 - protein, 19 aa, Artificial Sequence
  Description of Artificial Sequence: Synthetic peptide
ETVCPRTTQQSPEDCDFKK

SEQ ID NO: 55 - protein, 21 aa, Artificial Sequence
  Description of Artificial Sequence: Synthetic peptide
RCMGTVTLNQARGSFDISCDK

SEQ ID NO: 56 - protein, 11 aa, Artificial Sequence
  Description of Artificial Sequence: Synthetic peptide
CMGTVTLNQAR

SEQ ID NO: 57 - protein, 21 aa, Artificial Sequence
  Description of Artificial Sequence: Synthetic peptide
RCMGTVTLNQARGSFDISCDK

SEQ ID NO: 58 - protein, 17 aa, Artificial Sequence
  Description of Artificial Sequence: Synthetic peptide
AREGSEEDLDALEHMFR

SEQ ID NO: 59 - protein, 16 aa, Artificial Sequence
  Description of Artificial Sequence: Synthetic peptide
DPGETVGGDEIVMVIK

SEQ ID NO: 60 - protein, 15 aa, Artificial Sequence
  Description of Artificial Sequence: Synthetic peptide
EGSEEDLDALEHMFR

SEQ ID NO: 61 - protein, 11 aa, Artificial Sequence
  Description of Artificial Sequence: Synthetic peptide
MAEAELVQEGK

SEQ ID NO: 62 - protein, 12 aa, Artificial Sequence
  Description of Artificial Sequence: Synthetic peptide
RMAEAELVQEGK

SEQ ID NO: 63 - protein, 13 aa, Artificial Sequence
  Description of Artificial Sequence: Synthetic peptide
SLEEEKYDMSGAR

SEQ ID NO: 64 - protein, 28 aa, Artificial Sequence
  Description of Artificial Sequence: Synthetic peptide
AAQKADVLTTGAGNPVGDKLNVITVGPR

SEQ ID NO: 65 - protein, 24 aa, Artificial Sequence
  Description of Artificial Sequence: Synthetic peptide
ADVLTTGAGNPVGDKLNVITVGPR

SEQ ID NO: 66 - protein, 12 aa, Artificial Sequence
  Description of Artificial Sequence: Synthetic peptide
AFYVNVLNEEQR

SEQ ID NO: 67 - protein, 13 aa, Artificial Sequence
  Description of Artificial Sequence: Synthetic peptide
FNTANDDNVTQVR

SEQ ID NO: 68 - protein, 15 aa, Artificial Sequence
  Description of Artificial Sequence: Synthetic peptide
FSTVAGESGSADTVR

SEQ ID NO: 69 - protein, 21 aa, Artificial Sequence
  Description of Artificial Sequence: Synthetic peptide
FYTEDGNWDLVGNNTPIFFIR

SEQ ID NO: 70 - protein, 21 aa, Artificial Sequence
  Description of Artificial Sequence: Synthetic peptide
FYTEDGNWDLVGNNTPIFFIR

SEQ ID NO: 71 - protein, 21 aa, Artificial Sequence
  Description of Artificial Sequence: Synthetic peptide
FYTEDGNWDLVGNNTPIFFIR

SEQ ID NO: 72 - protein, 34 aa, Artificial Sequence
  Description of Artificial Sequence: Synthetic polypeptide
FYTEDGNWDLVGNNTPIFFIRDPILFPSFIHSQK

SEQ ID NO: 73 - protein, 19 aa, Artificial Sequence
  Description of Artificial Sequence: Synthetic peptide
GPLLVQDVVFTDEMAHFDR

SEQ ID NO: 74 - protein, 21 aa, Artificial Sequence
  Description of Artificial Sequence: Synthetic peptide
GPLLVQDVVFTDEMAHFDRER

SEQ ID NO: 75 - protein, 15 aa, Artificial Sequence
  Description of Artificial Sequence: Synthetic peptide
LGPNYLHIPVNCPYR

SEQ ID NO: 76 - protein, 11 aa, Artificial Sequence
  Description of Artificial Sequence: Synthetic peptide
LSQEDPDYGIR

SEQ ID NO: 77 - protein, 34 aa, Artificial Sequence
  Description of Artificial Sequence: Synthetic polypeptide
LVLNRNPVNYFAEVEQIAFDPSNMPPGIEASPDK

SEQ ID NO: 78 - protein, 34 aa, Artificial Sequence; identical to SEQ ID NO: 77
  Description of Artificial Sequence: Synthetic polypeptide

SEQ ID NO: 79 - protein, 30 aa, Artificial Sequence
  Description of Artificial Sequence: Synthetic polypeptide
NLSVEDAARLSQEDPDYGIRDLFNAIATGK

SEQ ID NO: 80 - protein, 30 aa, Artificial Sequence; identical to SEQ ID NO: 79
  Description of Artificial Sequence: Synthetic polypeptide

SEQ ID NO: 81 - protein, 30 aa, Artificial Sequence; identical to SEQ ID NO: 79
  Description of Artificial Sequence: Synthetic polypeptide

SEQ ID NO: 82 - skipped

SEQ ID NO: 83 - protein, 30 aa, Artificial Sequence; identical to SEQ ID NO: 79
  Description of Artificial Sequence: Synthetic polypeptide

SEQ ID NO: 84 - protein, 14 aa, Artificial Sequence
  Description of Artificial Sequence: Synthetic peptide
RFNTANDDNVTQVR

SEQ ID NO: 85 - protein, 11 aa, Artificial Sequence
  Description of Artificial Sequence: Synthetic peptide
DPASDQMQHWK

SEQ ID NO: 86 - protein, 26 aa, Artificial Sequence
  Description of Artificial Sequence: Synthetic peptide
DPDMVWDFWSLRPESLHQVSFLFSDR

SEQ ID NO: 87 - protein, 19 aa, Artificial Sequence
  Description of Artificial Sequence: Synthetic peptide
GPLLVQDVVFTDEMAHFDR

SEQ ID NO: 88 - protein, 21 aa, Artificial Sequence
  Description of Artificial Sequence: Synthetic peptide
GPLLVQDVVFTDEMAHFDRER

SEQ ID NO: 89 - protein, 11 aa, Artificial Sequence
  Description of Artificial Sequence: Synthetic peptide
HMNGYGSHTFK

SEQ ID NO: 90 - protein, 34 aa, Artificial Sequence; identical to SEQ ID NO: 77
  Description of Artificial Sequence: Synthetic polypeptide

SEQ ID NO: 91 - protein, 34 aa, Artificial Sequence; identical to SEQ ID NO: 77
  Description of Artificial Sequence: Synthetic polypeptide

SEQ ID NO: 92 - protein, 34 aa, Artificial Sequence; identical to SEQ ID NO: 77
  Description of Artificial Sequence: Synthetic polypeptide

SEQ ID NO: 93 - protein, 34 aa, Artificial Sequence; identical to SEQ ID NO: 77
  Description of Artificial Sequence: Synthetic polypeptide

SEQ ID NO: 94 - protein, 15 aa, Artificial Sequence
  Description of Artificial Sequence: Synthetic peptide
ADSRDPASDQMQHWK

SEQ ID NO: 95 - protein, 18 aa, Artificial Sequence
  Description of Artificial Sequence: Synthetic peptide
ADSRDPASDQMQHWKEQR

SEQ ID NO: 96 - protein, 33 aa, Artificial Sequence
  Description of Artificial Sequence: Synthetic polypeptide
NPQTHLKDPDMVWDFWSLRPESLHQVSFLFSDR

SEQ ID NO: 97 - protein, 29 aa, Artificial Sequence
  Description of Artificial Sequence: Synthetic peptide
NPVNYFAEVEQIAFDPSNMPPGIEASPDK

SEQ ID NO: 98 - protein, 29 aa, Artificial Sequence
  Description of Artificial Sequence: Synthetic peptide
NPVNYFAEVEQIAFDPSNMPPGIEASPDK

SEQ ID NO: 99 - protein, 11 aa, Artificial Sequence
  Description of Artificial Sequence: Synthetic peptide
LSQEDPDYGIR

SEQ ID NO: 100 - protein, 9 aa, Artificial Sequence
  Description of Artificial Sequence: Synthetic peptide
ELESIISKR

SEQ ID NO: 101 - protein, 11 aa, Artificial Sequence
  Description of Artificial Sequence: Synthetic peptide
LVGGDNLCSGR

SEQ ID NO: 102 - protein, 22 aa, Artificial Sequence
  Description of Artificial Sequence: Synthetic peptide
GSWSEWSTWGLCMPPCGPNPTR

SEQ ID NO: 103 - protein, 14 aa, Artificial Sequence
  Description of Artificial Sequence: Synthetic peptide
YPPTVSMVEGQGEK

SEQ ID NO: 104 - protein, 27 aa, Artificial Sequence
  Description of Artificial Sequence: Synthetic peptide
THICNTAVPCPVDGEWDSWGEWSPCIR

SEQ ID NO: 105 - protein, 27 aa, Artificial Sequence
  Description of Artificial Sequence: Synthetic peptide
CIVEVISDTLSKPSPMPVSQECFETLR

SEQ ID NO: 106 - protein, 27 aa, Artificial Sequence
  Description of Artificial Sequence: Synthetic peptide
CIVEVISDTLSKPSPMPVSQECFETLR

SEQ ID NO: 107 - protein, 15 aa, Artificial Sequence
  Description of Artificial Sequence: Synthetic peptide
EEEEEMAVVPQGLFR

SEQ ID NO: 108 - protein, 24 aa, Artificial Sequence
  Description of Artificial Sequence: Synthetic peptide
GEQEHSQQKEEEEEMAVVPQGLFR

SEQ ID NO: 109 - protein, 16 aa, Artificial Sequence
  Description of Artificial Sequence: Synthetic peptide
LEGQEEEEDNRDSSMK

SEQ ID NO: 110 - protein, 13 aa, Artificial Sequence
  Description of Artificial Sequence: Synthetic peptide
LPVNSPMNKGDTE

SEQ ID NO: 111 - protein, 17 aa, Artificial Sequence
  Description of Artificial Sequence: Synthetic peptide
RLEGQEEEEDNRDSSMK

SEQ ID NO: 112 - protein, 21 aa, Artificial Sequence
  Description of Artificial Sequence: Synthetic peptide
SGEATDGARPQALPEPMQESK

SEQ ID NO: 113 - protein, 13 aa, Artificial Sequence
  Description of Artificial Sequence: Synthetic peptide
GGKSGELEQEEER

SEQ ID NO: 114 - protein, 20 aa, Artificial Sequence
  Description of Artificial Sequence: Synthetic peptide
LEGQEEEEDNRDSSMKLSFR

SEQ ID NO: 115 - protein, 10 aa, Artificial Sequence
  Description of Artificial Sequence: Synthetic peptide
SGELEQEEER

SEQ ID NO: 116 - protein, 9 aa, Artificial Sequence
  Description of Artificial Sequence: Synthetic peptide
EEILMHLWR

SEQ ID NO: 117 - protein, 20 aa, Artificial Sequence
  Description of Artificial Sequence: Synthetic peptide
FIIEGMEEAGSVALEELVEK

SEQ ID NO: 118 - protein, 10 aa, Artificial Sequence
  Description of Artificial Sequence: Synthetic peptide
GNSYFMVEVK

SEQ ID NO: 119 - protein, 13 aa, Artificial Sequence
  Description of Artificial Sequence: Synthetic peptide
LFAAFFLEMAQLH

SEQ ID NO: 120 - protein, 8 aa, Artificial Sequence
  Description of Artificial Sequence: Synthetic peptide
MFQEIVHK

SEQ ID NO: 121 - protein, 11 aa, Artificial Sequence
  Description of Artificial Sequence: Synthetic peptide
MMAVAADTLQR

SEQ ID NO: 122 - protein, 11 aa, Artificial Sequence
  Description of Artificial Sequence: Synthetic peptide
MMAVAADTLQR

SEQ ID NO: 123 - protein, 25 aa, Artificial Sequence
  Description of Artificial Sequence: Synthetic peptide
MVVSMTLGLHPWIANIDDTQYLAAK

SEQ ID NO: 124 - protein, 25 aa, Artificial Sequence
  Description of Artificial Sequence: Synthetic peptide
MVVSMTLGLHPWIANIDDTQYLAAK

SEQ ID NO: 125 - protein, 11 aa, Artificial Sequence
  Description of Artificial Sequence: Synthetic peptide
MMAVAADTLQR

SEQ ID NO: 126 - protein, 25 aa, Artificial Sequence
  Description of Artificial Sequence: Synthetic peptide
MVVSMTLGLHPWIANIDDTQYLAAK

SEQ ID NO: 127 - protein, 11 aa, Artificial Sequence
  Description of Artificial Sequence: Synthetic peptide
TVFGTEPDMIR

SEQ ID NO: 128 - protein, 33 aa, Artificial Sequence
  Description of Artificial Sequence: Synthetic polypeptide
VASVDMGPQQLPDGQSLPIPPVILAELGSDPTK

SEQ ID NO: 129 - protein, 20 aa, Artificial Sequence
  Description of Artificial Sequence: Synthetic peptide
FIIEGMEEAGSVALEELVEK

SEQ ID NO: 130 - protein, 17 aa, Artificial Sequence
  Description of Artificial Sequence: Synthetic peptide
HEEAPGHRPTTNPNASK

SEQ ID NO: 131 - protein, 9 aa, Artificial Sequence
  Description of Artificial Sequence: Synthetic peptide
SCFLCMVCK

SEQ ID NO: 132 - protein, 9 aa, Artificial Sequence
  Description of Artificial Sequence: Synthetic peptide
SCFLCMVCK

SEQ ID NO: 133 - protein, 9 aa, Artificial Sequence
  Description of Artificial Sequence: Synthetic peptide
SCFLCMVCK

SEQ ID NO: 134 - protein, 15 aa, Artificial Sequence
  Description of Artificial Sequence: Synthetic peptide
GFGFGQGAGALVHSE

SEQ ID NO: 135 - protein, 22 aa, Artificial Sequence
  Description of Artificial Sequence: Synthetic peptide
MIPGGLSEAKPATPEIQEIVDK

SEQ ID NO: 136 - protein, 10 aa, Artificial Sequence
  Description of Artificial Sequence: Synthetic peptide
MIPGGLSEAK

SEQ ID NO: 137 - protein, 22 aa, Artificial Sequence
  Description of Artificial Sequence: Synthetic peptide
MIPGGLSEAKPATPEIQEIVDK

SEQ ID NO: 138 - protein, 22 aa, Artificial Sequence
  Description of Artificial Sequence: Synthetic peptide
MIPGGLSEAKPATPEIQEIVDK

SEQ ID NO: 139 - protein, 14 aa, Artificial Sequence
  Description of Artificial Sequence: Synthetic peptide
NSWGEEWGMGGYVK

SEQ ID NO: 140 - protein, 10 aa, Artificial Sequence
  Description of Artificial Sequence: Synthetic peptide
AGVLFGMSDR

SEQ ID NO: 141 - protein, 31 aa, Artificial Sequence
  Description of Artificial Sequence: Synthetic polypeptide
GNEALVHHMEVFQCAPEMDSVPHFSGPCDSK

SEQ ID NO: 142 - protein, 22 aa, Artificial Sequence
  Description of Artificial Sequence: Synthetic peptide
ASAISVTVLNVIEGPVFRPGSK

SEQ ID NO: 143 - protein, 12 aa, Artificial Sequence
  Description of Artificial Sequence: Synthetic peptide
AEFHHSIMSQYK

SEQ ID NO: 144 - protein, 16 aa, Artificial Sequence
  Description of Artificial Sequence: Synthetic peptide
ALNSMGQDLERPLELR

SEQ ID NO: 145 - protein, 16 aa, Artificial Sequence
  Description of Artificial Sequence: Synthetic peptide
DGGADGMSAECECNIK

SEQ ID NO: 146 - protein, 16 aa, Artificial Sequence
  Description of Artificial Sequence: Synthetic peptide
EGGLNMNFMESYFCQK

SEQ ID NO: 147 - protein, 9 aa, Artificial Sequence
  Description of Artificial Sequence: Synthetic peptide
EQYNMLGGK

SEQ ID NO: 148 - protein, 20 aa, Artificial Sequence
  Description of Artificial Sequence: Synthetic peptide
GSDRDGGADGMSAECECNIK

SEQ ID NO: 149 - protein, 11 aa, Artificial Sequence
  Description of Artificial Sequence: Synthetic peptide
MTGFELTEGVK

SEQ ID NO: 150 - protein, 19 aa, Artificial Sequence
  Description of Artificial Sequence: Synthetic peptide
TMNNFLDREQYGQYALAVR

SEQ ID NO: 151 - protein, 16 aa, Artificial Sequence
  Description of Artificial Sequence: Synthetic peptide
TSGMPEICQEYSGTLR

SEQ ID NO: 152 - protein, 13 aa, Artificial Sequence
  Description of Artificial Sequence: Synthetic peptide
TYVVTGNMGSNDK

SEQ ID NO: 153 - protein, 32 aa, Artificial Sequence
  Description of Artificial Sequence: Synthetic polypeptide
TYVVTGNMGSNDKVGDFVATDLDTGRPSTTVR

SEQ ID NO: 154 - protein, 29 aa, Artificial Sequence
  Description of Artificial Sequence: Synthetic peptide
VIQPTSGMIGSLSMHPELANAHNVIVTER

SEQ ID NO: 155 - protein, 20 aa, Artificial Sequence
  Description of Artificial Sequence: Synthetic peptide
VVGPISGADLHGMLEMPDLR

SEQ ID NO: 156 - protein, 20 aa, Artificial Sequence
  Description of Artificial Sequence: Synthetic peptide
VVGPISGADLHGMLEMPDLR

SEQ ID NO: 157 - protein, 20 aa, Artificial Sequence
  Description of Artificial Sequence: Synthetic peptide
VVGPISGADLHGMLEMPDLR

SEQ ID NO: 158 - protein, 20 aa, Artificial Sequence
  Description of Artificial Sequence: Synthetic peptide
VVKPLDYEAMQSLQLSIGVR

SEQ ID NO: 159 - protein, 16 aa, Artificial Sequence
  Description of Artificial Sequence: Synthetic peptide
YVMGNNPADLLAVDSR

SEQ ID NO: 160 - protein, 29 aa, Artificial Sequence
  Description of Artificial Sequence: Synthetic peptide
SAAGFEPVPECSDGAIHSWAVEGPQPEPR

SEQ ID NO: 161 - protein, 20 aa, Artificial Sequence
  Description of Artificial Sequence: Synthetic peptide
SSSDHHFNQTIGSASPSTAR

SEQ ID NO: 162 - protein, 20 aa, Artificial Sequence
  Description of Artificial Sequence: Synthetic peptide
SSSDHHFNQTIGSASPSTAR

SEQ ID NO: 163 - protein, 23 aa, Artificial Sequence
  Description of Artificial Sequence: Synthetic peptide
AEMDMVAWGVDLASVEQHINSHR

SEQ ID NO: 164 - protein, 30 aa, Artificial Sequence; identical to SEQ ID NO: 6
  Description of Artificial Sequence: Synthetic polypeptide

SEQ ID NO: 165 - protein, 25 aa, Artificial Sequence
  Description of Artificial Sequence: Synthetic peptide
LISPESTVMLLEAQAATGGIIDPHR

SEQ ID NO: 166 - protein, 19 aa, Artificial Sequence
  Description of Artificial Sequence: Synthetic peptide
LLEAQIATGGIIDPKESHR

SEQ ID NO: 167 - protein, 35 aa, Artificial Sequence
  Description of Artificial Sequence: Synthetic polypeptide
QPVTVTELVDSGILRPSTVNELESGQISYDEVGER

SEQ ID NO: 168 - protein, 9 aa, Artificial Sequence
  Description of Artificial Sequence: Synthetic peptide
RQDSLESMK

SEQ ID NO: 169 - protein, 23 aa, Artificial Sequence
  Description of Artificial Sequence: Synthetic peptide
AEMDMVAWGVDLASVEQHINSHR

SEQ ID NO: 170 - protein, 23 aa, Artificial Sequence
  Description of Artificial Sequence: Synthetic peptide
AEMDMVAWGVDLASVEQHINSHR

SEQ ID NO: 171 - protein, 23 aa, Artificial Sequence
  Description of Artificial Sequence: Synthetic peptide
AEMDMVAWGVDLASVEQHINSHR

SEQ ID NO: 172 - protein, 14 aa, Artificial Sequence
  Description of Artificial Sequence: Synthetic peptide
ALLQAILQTEDMLK

SEQ ID NO: 173 - protein, 22 aa, Artificial Sequence
  Description of Artificial Sequence: Synthetic peptide
AVTGYNDPETGNIISLFQAMNK

SEQ ID NO: 174 - protein, 10 aa, Artificial Sequence
  Description of Artificial Sequence: Synthetic peptide
EHLMLEEELR

SEQ ID NO: 175 - protein, 21 aa, Artificial Sequence
  Description of Artificial Sequence: Synthetic peptide
ELDECFAQANDQMEILDSLIR

SEQ ID NO: 176 - protein, 21 aa, Artificial Sequence
  Description of Artificial Sequence: Synthetic peptide
ELDECFAQANDQMEILDSLIR

SEQ ID NO: 177 - protein, 9 aa, Artificial Sequence
  Description of Artificial Sequence: Synthetic peptide
EMSVQEAYK

SEQ ID NO: 178 - protein, 15 aa, Artificial Sequence
  Description of Artificial Sequence: Synthetic peptide
ENDKQETWMLMELQK

SEQ ID NO: 179 - protein, 9 aa, Artificial Sequence
  Description of Artificial Sequence: Synthetic peptide
FGDSNTVMR

SEQ ID NO: 180 - protein, 15 aa, Artificial Sequence
  Description of Artificial Sequence: Synthetic peptide
GLPSPYNMSSAPGSR

SEQ ID NO: 181 - protein, 19 aa, Artificial Sequence
  Description of Artificial Sequence: Synthetic peptide
GVITDQNSDGYCQTGTMSR

SEQ ID NO: 182 - protein, 19 aa, Artificial Sequence
  Description of Artificial Sequence: Synthetic peptide
GVITDQNSDGYCQTGTMSR

SEQ ID NO: 183 - protein, 19 aa, Artificial Sequence
  Description of Artificial Sequence: Synthetic peptide
GVITDQNSDGYCQTGTMSR

SEQ ID NO: 184 - protein, 20 aa, Artificial Sequence
  Description of Artificial Sequence: Synthetic peptide
HQNQNTIQELLQNCSDCLMR

SEQ ID NO: 185 - protein, 20 aa, Artificial Sequence
  Description of Artificial Sequence: Synthetic peptide
HQNQNTIQELLQNCSDCLMR

SEQ ID NO: 186 - protein, 11 aa, Artificial Sequence
  Description of Artificial Sequence: Synthetic peptide
HVTSECLGWMR

SEQ ID NO: 187 - protein, 10 aa, Artificial Sequence
  Description of Artificial Sequence: Synthetic peptide
KLEEELEGMR

SEQ ID NO: 188 - protein, 9 aa, Artificial Sequence
  Description of Artificial Sequence: Synthetic peptide
LEEELEGMR

SEQ ID NO: 189 - protein, 8 aa, Artificial Sequence
  Description of Artificial Sequence: Synthetic peptide
LGIYEAMK

SEQ ID NO: 190 - protein, 25 aa, Artificial Sequence
  Description of Artificial Sequence: Synthetic peptide
LISPESTVMLLEAQAATGGIIDPHR

SEQ ID NO: 191 - protein, 28 aa, Artificial Sequence
  Description of Artificial Sequence: Synthetic peptide
LISPESTVMLLEAQAATGGIIDPHRNEK

SEQ ID NO: 192 - protein, 9 aa, Artificial Sequence
  Description of Artificial Sequence: Synthetic peptide
LLQLQEQMR

SEQ ID NO: 193 - protein, 19 aa, Artificial Sequence
  Description of Artificial Sequence: Synthetic peptide
LSLQDAVSQGVIDQDMATR

SEQ ID NO: 194 - protein, 7 aa, Artificial Sequence
  Description of Artificial Sequence: Synthetic peptide
MSQLEVK

SEQ ID NO: 195 - protein, 22 aa, Artificial Sequence
  Description of Artificial Sequence: Synthetic peptide
NGVGTSSSMGSGVSDDVFSSSR

SEQ ID NO: 196 - protein, 11 aa, Artificial Sequence
  Description of Artificial Sequence: Synthetic peptide
NHYNEEMSNLR

SEQ ID NO: 197 - protein, 12 aa, Artificial Sequence
  Description of Artificial Sequence: Synthetic peptide
NMPLQHLLEQIK

SEQ ID NO: 198 - protein, 13 aa, Artificial Sequence
  Description of Artificial Sequence: Synthetic peptide
NSQGSEMFGDDDK

SEQ ID NO: 199 - protein, 14 aa, Artificial Sequence
  Description of Artificial Sequence: Synthetic peptide
NSQGSEMFGDDDKR

SEQ ID NO: 200 - protein, 15 aa, Artificial Sequence
  Description of Artificial Sequence: Synthetic peptide
NSQGSEMFGDDDKRK

SEQ ID NO: 201 - protein, 11 aa, Artificial Sequence
  Description of Artificial Sequence: Synthetic peptide
QMGQPCDAYQK

SEQ ID NO: 202 - protein, 20 aa, Artificial Sequence
  Description of Artificial Sequence: Synthetic peptide
RGVITDQNSDGYCQTGTMSR

SEQ ID NO: 203 - protein, 20 aa, Artificial Sequence
  Description of Artificial Sequence: Synthetic peptide
RGVITDQNSDGYCQTGTMSR

SEQ ID NO: 204 - protein, 20 aa, Artificial Sequence
  Description of Artificial Sequence: Synthetic peptide
RGVITDQNSDGYCQTGTMSR

SEQ ID NO: 205 - protein, 9 aa, Artificial Sequence
  Description of Artificial Sequence: Synthetic peptide
RQDSLESMK

SEQ ID NO: 206 - protein, 16 aa, Artificial Sequence
  Description of Artificial Sequence: Synthetic peptide
SGSLSLTQFADMISLK

SEQ ID NO: 207 - protein, 14 aa, Artificial Sequence
  Description of Artificial Sequence: Synthetic peptide
SLVSWHYCMIDIEK

SEQ ID NO: 208 - protein, 10 aa, Artificial Sequence
  Description of Artificial Sequence: Synthetic peptide
SMVEDITGLR

SEQ ID NO: 209 - protein, 23 aa, Artificial Sequence
  Description of Artificial Sequence: Synthetic peptide
SRELDECFAQANDQMEILDSLIR

SEQ ID NO: 210 - protein, 23 aa, Artificial Sequence
  Description of Artificial Sequence: Synthetic peptide
SRELDECFAQANDQMEILDSLIR

SEQ ID NO: 211 - protein, 24 aa, Artificial Sequence
  Description of Artificial Sequence: Synthetic peptide
SVQNDSQAIAEVLNQLKDMLANFR

SEQ ID NO: 212 - protein, 20 aa, Artificial Sequence
  Description of Artificial Sequence: Synthetic peptide
TMIQSPSGVILQEAADVHAR

SEQ ID NO: 213 - protein, 10 aa, Artificial Sequence
  Description of Artificial Sequence: Synthetic peptide
TTIHQLTMQK

SEQ ID NO: 214 - protein, 13 aa, Artificial Sequence
  Description of Artificial Sequence: Synthetic peptide
VRNHYNEEMSNLR

SEQ ID NO: 215 - protein, 14 aa, Artificial Sequence
  Description of Artificial Sequence: Synthetic peptide
VTAMQLYECQLIDK

SEQ ID NO: 216 - protein, 18 aa, Artificial Sequence
  Description of Artificial Sequence: Synthetic peptide
GGGGYTCQSGSGWDEFTK

SEQ ID NO: 217 - protein, 18 aa, Artificial Sequence
  Description of Artificial Sequence: Synthetic peptide
GGGGYTCQSGSGWDEFTK

SEQ ID NO: 218 - protein, 18 aa, Artificial Sequence
  Description of Artificial Sequence: Synthetic peptide
GGGGYTCQSGSGWDEFTK

SEQ ID NO: 219 - protein, 15 aa, Artificial Sequence
  Description of Artificial Sequence: Synthetic peptide
GLPSPYNMSSAPGSR

SEQ ID NO: 220 - protein, 15 aa, Artificial Sequence
  Description of Artificial Sequence: Synthetic peptide
GLPSPYNMSSAPGSR

SEQ ID NO: 221 - protein, 15 aa, Artificial Sequence
  Description of Artificial Sequence: Synthetic peptide
GLPSPYNMSSAPGSR

SEQ ID NO: 222 - protein, 9 aa, Artificial Sequence
  Description of Artificial Sequence: Synthetic peptide
LPVEEAYKR

SEQ ID NO: 223 - protein, 11 aa, Artificial Sequence
  Description of Artificial Sequence: Synthetic peptide
QETWMLMELQK

SEQ ID NO: 224 - protein, 25 aa, Artificial Sequence
  Description of Artificial Sequence: Synthetic peptide
RGSFDATGNSSYSYSYSFSSSSIGH

SEQ ID NO: 225 - protein, 25 aa, Artificial Sequence
  Description of Artificial Sequence: Synthetic peptide
RGSFDATGNSSYSYSYSFSSSSIGH

SEQ ID NO: 226 - protein, 10 aa, Artificial Sequence
  Description of Artificial Sequence: Synthetic peptide
RTASEDSCKR

SEQ ID NO: 227 - protein, 8 aa, Artificial Sequence
  Description of Artificial Sequence: Synthetic peptide
SMSFQGIR

SEQ ID NO: 228 - protein, 25 aa, Artificial Sequence
  Description of Artificial Sequence: Synthetic peptide
SSSFSDTLEESSPIAAIFDTENLEK

SEQ ID NO: 229 - protein, 8 aa, Artificial Sequence
  Description of Artificial Sequence: Synthetic peptide
SMSFQGIR

SEQ ID NO: 230 - protein, 25 aa, Artificial Sequence
  Description of Artificial Sequence: Synthetic peptide
SSSFSDTLEESSPIAAIFDTENLEK

SEQ ID NO: 231 - protein, 25 aa, Artificial Sequence
  Description of Artificial Sequence: Synthetic peptide
SSSFSDTLEESSPIAAIFDTENLEK

SEQ ID NO: 232 - protein, 25 aa, Artificial Sequence
  Description of Artificial Sequence: Synthetic peptide
SSSFSDTLEESSPIAAIFDTENLEK

SEQ ID NO: 233 - protein, 25 aa, Artificial Sequence
  Description of Artificial Sequence: Synthetic peptide
SSSFSDTLEESSPIAAIFDTENLEK

SEQ ID NO: 234 - protein, 25 aa, Artificial Sequence
  Description of Artificial Sequence: Synthetic peptide
SSSFSDTLEESSPIAAIFDTENLEK

SEQ ID NO: 235 - protein, 15 aa, Artificial Sequence
  Description of Artificial Sequence: Synthetic peptide
GLPSPYNMSSAPGSR

SEQ ID NO: 236 - protein, 15 aa, Artificial Sequence
  Description of Artificial Sequence: Synthetic peptide
KVTAMQLYECQLIDK

SEQ ID NO: 237 - protein, 8 aa, Artificial Sequence
  Description of Artificial Sequence: Synthetic peptide
SMSFQGIR

SEQ ID NO: 238 - protein, 14 aa, Artificial Sequence
  Description of Artificial Sequence: Synthetic peptide
VTAMQLYECQLIDK

SEQ ID NO: 239 - protein, 16 aa, Artificial Sequence
  Description of Artificial Sequence: Synthetic peptide
FSCFQEEAPQPHYQLR

SEQ ID NO: 240 - protein, 9 aa, Artificial Sequence
  Description of Artificial Sequence: Synthetic peptide
LVWEEAMSR

SEQ ID NO: 241 - protein, 37 aa, Artificial Sequence
  Description of Artificial Sequence: Synthetic polypeptide
SLPMDHPDSSQHGPPFEGQSQVQPPPSQEATPLQQEK

SEQ ID NO: 242 - protein, 37 aa, Artificial Sequence; identical to SEQ ID NO: 241
  Description of Artificial Sequence: Synthetic polypeptide

SEQ ID NO: 243 - protein, 14 aa, Artificial Sequence
  Description of Artificial Sequence: Synthetic peptide
VTPNLMGHLCGNQR

SEQ ID NO: 244 - protein, 27 aa, Artificial Sequence
  Description of Artificial Sequence: Synthetic peptide
LVWEEAMSRFCEAEFSVKTRPHWCCTR

SEQ ID NO: 245 - protein, 30 aa, Artificial Sequence
  Description of Artificial Sequence: Synthetic polypeptide
GIRVLRLSLVVILVLLLVAGALTALLPSVK

SEQ ID NO: 246 - protein, 30 aa, Artificial Sequence; identical to SEQ ID NO: 245
  Description of Artificial Sequence: Synthetic polypeptide

SEQ ID NO: 247 - protein, 29 aa, Artificial Sequence
  Description of Artificial Sequence: Synthetic peptide
IRVLRLSLVVILVLLLVAGALTALLPSVK

SEQ ID NO: 248 - protein, 11 aa, Artificial Sequence
  Description of Artificial Sequence: Synthetic peptide
KMKEALLSIGK

SEQ ID NO: 249 - protein, 10 aa, Artificial Sequence
  Description of Artificial Sequence: Synthetic peptide
MKEALLSIGK

SEQ ID NO: 250 - protein, 7 aa, Artificial Sequence
  Description of Artificial Sequence: Synthetic peptide
MQGLMFR

SEQ ID NO: 251 - protein, 7 aa, Artificial Sequence
  Description of Artificial Sequence: Synthetic peptide
MQGLMFR

SEQ ID NO: 252 - protein, 17 aa, Artificial Sequence
  Description of Artificial Sequence: Synthetic peptide
AELQQLRVQEAVESMVK

SEQ ID NO: 253 - protein, 10 aa, Artificial Sequence
  Description of Artificial Sequence: Synthetic peptide
VQEAVESMVK

SEQ ID NO: 254 - protein, 19 aa, Artificial Sequence
  Description of Artificial Sequence: Synthetic peptide
AENGKLVINGNPITIFQER

SEQ ID NO: 255 - protein, 23 aa, Artificial Sequence
  Description of Artificial Sequence: Synthetic peptide
AENGKLVINGNPITIFQERDPSK

SEQ ID NO: 256 - protein, 26 aa, Artificial Sequence
  Description of Artificial Sequence: Synthetic peptide
LISWYDNEFGYSNRVVDLMAHMASKE

SEQ ID NO: 257 - protein, 26 aa, Artificial Sequence
  Description of Artificial Sequence: Synthetic peptide
LISWYDNEFGYSNRVVDLMAHMASKE

SEQ ID NO: 258 - protein, 14 aa, Artificial Sequence
  Description of Artificial Sequence: Synthetic peptide
LISWYDNEFGYSNR

SEQ ID NO: 259 - protein, 26 aa, Artificial Sequence
  Description of Artificial Sequence: Synthetic peptide
LISWYDNEFGYSNRVVDLMAHMASKE

SEQ ID NO: 260 - protein, 14 aa, Artificial Sequence
  Description of Artificial Sequence: Synthetic peptide
LVINGNPITIFQER

SEQ ID NO: 261 - protein, 18 aa, Artificial Sequence
  Description of Artificial Sequence: Synthetic peptide
LVINGNPITIFQERDPSK

SEQ ID NO: 262 - protein, 18 aa, Artificial Sequence
  Description of Artificial Sequence: Synthetic peptide
LVINGNPITIFQERDPSK

SEQ ID NO: 263 - protein, 14 aa, Artificial Sequence
  Description of Artificial Sequence: Synthetic peptide
LVINGNPITIFQER

SEQ ID NO: 264 - protein, 18 aa, Artificial Sequence
  Description of Artificial Sequence: Synthetic peptide
LVINGNPITIFQERDPSK

SEQ ID NO: 265 - protein, 20 aa, Artificial Sequence
  Description of Artificial Sequence: Synthetic peptide
LVINGNPITIFQERDPSKIK

SEQ ID NO: 266 - protein, 21 aa, Artificial Sequence
  Description of Artificial Sequence: Synthetic peptide
LWRDGRGALQNIIPASTGAAK

SEQ ID NO: 267 - protein, 21 aa, Artificial Sequence
  Description of Artificial Sequence: Synthetic peptide
LWRDGRGALQNIIPASTGAAK

SEQ ID NO: 268 - protein, 21 aa, Artificial Sequence
  Description of Artificial Sequence: Synthetic peptide
LWRDGRGALQNIIPASTGAAK

SEQ ID NO: 269 - protein, 21 aa, Artificial Sequence
  Description of Artificial Sequence: Synthetic peptide
LWRDGRGALQNIIPASTGAAK

SEQ ID NO: 270 - protein, 21 aa, Artificial Sequence
  Description of Artificial Sequence: Synthetic peptide
LWRDGRGALQNIIPASTGAAK

SEQ ID NO: 271 - protein, 21 aa, Artificial Sequence
  Description of Artificial Sequence: Synthetic peptide
LWRDGRGALQNIIPASTGAAK

SEQ ID NO: 272 - protein, 22 aa, Artificial Sequence
  Description of Artificial Sequence: Synthetic peptide
RVIISAPSADAPMFVMGVNHEK

SEQ ID NO: 273 - protein, 22 aa, Artificial Sequence
  Description of Artificial Sequence: Synthetic peptide
RVIISAPSADAPMFVMGVNHEK

SEQ ID NO: 274 - protein, 28 aa, Artificial Sequence
  Description of Artificial Sequence: Synthetic peptide
RVIISAPSADAPMFVMGVNHEKYDNSLK

SEQ ID NO: 275 - protein, 8 aa, Artificial Sequence
  Description of Artificial Sequence: Synthetic peptide
VGVNGFGR

SEQ ID NO: 276 - protein, 15 aa, Artificial Sequence
  Description of Artificial Sequence: Synthetic peptide
VGVNGFGRIGRLVTR

SEQ ID NO: 277 - protein, 8 aa, Artificial Sequence
  Description of Artificial Sequence: Synthetic peptide
VGVNGFGR

SEQ ID NO: 278 - protein, 24 aa, Artificial Sequence
  Description of Artificial Sequence: Synthetic peptide
VIHDNFGIVEGLMTTVHAITATQR

SEQ ID NO: 279 - protein, 24 aa, Artificial Sequence
  Description of Artificial Sequence: Synthetic peptide
VIHDNFGIVEGLMTTVHAITATQR

SEQ ID NO: 280 - protein, 14 aa, Artificial Sequence
  Description of Artificial Sequence: Synthetic peptide
VPTANVSVVDLTCR

SEQ ID NO: 281 - protein, 20 aa, Artificial Sequence
  Description of Artificial Sequence: Synthetic peptide
VPTANVSVVDLTCRLEKPAK

SEQ ID NO: 282 - protein, 22 aa, Artificial Sequence
  Description of Artificial Sequence: Synthetic peptide
RVIISAPSADAPMFVMGVNHEK

SEQ ID NO: 283 - protein, 22 aa, Artificial Sequence
  Description of Artificial Sequence: Synthetic peptide
RVIISAPSADAPMFVMGVNHEK

SEQ ID NO: 284 - protein, 22 aa, Artificial Sequence
  Description of Artificial Sequence: Synthetic peptide
RVIISAPSADAPMFVMGVNHEK

SEQ ID NO: 285 - protein, 28 aa, Artificial Sequence
  Description of Artificial Sequence: Synthetic peptide
RVIISAPSADAPMFVMGVNHEKYDNSLK

SEQ ID NO: 286 - protein, 22 aa, Artificial Sequence
  Description of Artificial Sequence: Synthetic peptide
RVIISAPSADAPMFVMGVNHEK

SEQ ID NO: 287 - protein, 22 aa, Artificial Sequence
  Description of Artificial Sequence: Synthetic peptide
RVIISAPSADAPMFVMGVNHEK

SEQ ID NO: 288 - protein, 14 aa, Artificial Sequence
  Description of Artificial Sequence: Synthetic peptide
LISWYDNEFGYSNR

SEQ ID NO: 289 - protein, 18 aa, Artificial Sequence
  Description of Artificial Sequence: Synthetic peptide
FGYSNRVVDLMAHMASKE

SEQ ID NO: 290 - protein, 25 aa, Artificial Sequence
  Description of Artificial Sequence: Synthetic peptide
GGAKRVIISAPSADAPMFVMGVNHE

SEQ ID NO: 291 - protein, 17 aa, Artificial Sequence
  Description of Artificial Sequence: Synthetic peptide
GLMTTVHAITATQKTVD

SEQ ID NO: 292 - protein, 23 aa, Artificial Sequence
  Description of Artificial Sequence: Synthetic peptide
IKWGDAGAEYVVESTGVFTTMEK

SEQ ID NO: 293 - protein, 32 aa, Artificial Sequence
  Description of Artificial Sequence: Synthetic polypeptide
KAGAHLQGGAKRVIISAPSADAPMFVMGVNHE

SEQ ID NO: 294 - protein, 7 aa, Artificial Sequence
  Description of Artificial Sequence: Synthetic peptide
LTGMAFR

SEQ ID NO: 295 - protein, 21 aa, Artificial Sequence
  Description of Artificial Sequence: Synthetic peptide
LTGMAFRVPTANVSVVDLTCR

SEQ ID NO: 296 - protein, 24 aa, Artificial Sequence
  Description of Artificial Sequence: Synthetic peptide
LTGMAFRVPTANVSVVDLTCRLEK

SEQ ID NO: 297 - protein, 12 aa, Artificial Sequence
  Description of Artificial Sequence: Synthetic peptide
MTTVHAITATQK

SEQ ID NO: 298 - protein, 22 aa, Artificial Sequence
  Description of Artificial Sequence: Synthetic peptide
RVIISAPSADAPMFVMGVNHEK

SEQ ID NO: 299 - protein, 22 aa, Artificial Sequence
  Description of Artificial Sequence: Synthetic peptide
RVIISAPSADAPMFVMGVNHEK

SEQ ID NO: 300 - protein, 28 aa, Artificial Sequence
  Description of Artificial Sequence: Synthetic peptide
RVIISAPSADAPMFVMGVNHEKYDNSLK

SEQ ID NO: 301 - protein, 22 aa, Artificial Sequence
  Description of Artificial Sequence: Synthetic peptide
RVIISAPSADAPMFVMGVNHEK

SEQ ID NO: 302 - protein, 22 aa, Artificial Sequence
  Description of Artificial Sequence: Synthetic peptide
RVIISAPSADAPMFVMGVNHEK

SEQ ID NO: 303 - protein, 28 aa, Artificial Sequence
  Description of Artificial Sequence: Synthetic peptide
RVIISAPSADAPMFVMGVNHEKYDNSLK

SEQ ID NO: 304 - protein, 28 aa, Artificial Sequence
  Description of Artificial Sequence: Synthetic peptide
RVIISAPSADAPMFVMGVNHEKYDNSLK

SEQ ID NO: 305 - protein, 22 aa, Artificial Sequence
  Description of Artificial Sequence: Synthetic peptide
RVIISAPSADAPMFVMGVNHEK

SEQ ID NO: 306 - protein, 22 aa, Artificial Sequence
  Description of Artificial Sequence: Synthetic peptide
RVIISAPSADAPMFVMGVNHEK

SEQ ID NO: 307 - protein, 28 aa, Artificial Sequence
  Description of Artificial Sequence: Synthetic peptide
RVIISAPSADAPMFVMGVNHEKYDNSLK

SEQ ID NO: 308 - protein, 28 aa, Artificial Sequence
  Description of Artificial Sequence: Synthetic peptide
VDIVAINDPFIDLNYMVYMFQYDSTHGK

SEQ ID NO: 309 - protein, 28 aa, Artificial Sequence
  Description of Artificial Sequence: Synthetic peptide
VDIVAINDPFIDLNYMVYMFQYDSTHGK

SEQ ID NO: 310 - protein, 28 aa, Artificial Sequence
  Description of Artificial Sequence: Synthetic peptide
VDIVAINDPFIDLNYMVYMFQYDSTHGK

SEQ ID NO: 311 - protein, 28 aa, Artificial Sequence
  Description of Artificial Sequence: Synthetic peptide
VDIVAINDPFIDLNYMVYMFQYDSTHGK

SEQ ID NO: 312 - protein, 28 aa, Artificial Sequence
  Description of Artificial Sequence: Synthetic peptide
VDIVAINDPFIDLNYMVYMFQYDSTHGK

SEQ ID NO: 313 - protein, 28 aa, Artificial Sequence
  Description of Artificial Sequence: Synthetic peptide
VDIVAINDPFIDLNYMVYMFQYDSTHGK

SEQ ID NO: 314 - protein, 24 aa, Artificial Sequence
  Description of Artificial Sequence: Synthetic peptide
VIHDNFGIVEGLMTTVHAITATQK

SEQ ID NO: 315 - protein, 24 aa, Artificial Sequence
  Description of Artificial Sequence: Synthetic peptide
VIHDNFGIVEGLMTTVHAITATQK

SEQ ID NO: 316 - protein, 13 aa, Artificial Sequence
  Description of Artificial Sequence: Synthetic peptide
VIHDNFGIVEGLM

SEQ ID NO: 317 - protein, 24 aa, Artificial Sequence
  Description of Artificial Sequence: Synthetic peptide
VIHDNFGIVEGLMTTVHAITATQK

SEQ ID NO: 318 - protein, 32 aa, Artificial Sequence
  Description of Artificial Sequence: Synthetic polypeptide
VIHDNFGIVEGLMTTVHAITATQKTVDGPSGK

SEQ ID NO: 319 - protein, 24 aa, Artificial Sequence
  Description of Artificial Sequence: Synthetic peptide
VIHDNFGIVEGLMTTVHAITATQR

SEQ ID NO: 320 - protein, 21 aa, Artificial Sequence
  Description of Artificial Sequence: Synthetic peptide
VIISAPSADAPMFVMGVNHEK

SEQ ID NO: 321 - protein, 21 aa, Artificial Sequence
  Description of Artificial Sequence: Synthetic peptide
VIISAPSADAPMFVMGVNHEK

SEQ ID NO: 322 - protein, 21 aa, Artificial Sequence
  Description of Artificial Sequence: Synthetic peptide
VIISAPSADAPMFVMGVNHEK

SEQ ID NO: 323 - protein, 27 aa, Artificial Sequence
  Description of Artificial Sequence: Synthetic peptide
VIISAPSADAPMFVMGVNHEKYDNSLK

SEQ ID NO: 324 - protein, 21 aa, Artificial Sequence
  Description of Artificial Sequence: Synthetic peptide
VIISAPSADAPMFVMGVNHEK

SEQ ID NO: 325 - protein, 15 aa, Artificial Sequence
  Description of Artificial Sequence: Synthetic peptide
VIPELNGKLTGMAFR

SEQ ID NO: 326 - protein, 15 aa, Artificial Sequence
  Description of Artificial Sequence: Synthetic peptide
VIPELNGKLTGMAFR

SEQ ID NO: 327 - protein, 11 aa, Artificial Sequence
  Description of Artificial Sequence: Synthetic peptide
VVDLMAHMASK

SEQ ID NO: 328 - protein, 12 aa, Artificial Sequence
  Description of Artificial Sequence: Synthetic peptide
VVDLMAHMASKE

SEQ ID NO: 329 - protein, 11 aa, Artificial Sequence
  Description of Artificial Sequence: Synthetic peptide
VVDLMAHMASK

SEQ ID NO: 330 - protein, 12 aa, Artificial Sequence
  Description of Artificial Sequence: Synthetic peptide
VVDLMAHMASKE

SEQ ID NO: 331 - protein, 11 aa, Artificial Sequence
  Description of Artificial Sequence: Synthetic peptide
VVDLMAHMASK

SEQ ID NO: 332 - protein, 12 aa, Artificial Sequence
  Description of Artificial Sequence: Synthetic peptide
VVDLMAHMASKE

SEQ ID NO: 333 - protein, 21 aa, Artificial Sequence
  Description of Artificial Sequence: Synthetic peptide
WGDAGAEYVVESTGVFTTMEK

SEQ ID NO: 334 - protein, 11 aa, Artificial Sequence
  Description of Artificial Sequence: Synthetic peptide
YMFQYDSTHGK

SEQ ID NO: 335 - protein, 14 aa, Artificial Sequence
  Description of Artificial Sequence: Synthetic peptide
YVVESTGVFTTMEK

SEQ ID NO: 336 - protein, 24 aa, Artificial Sequence
  Description of Artificial Sequence: Synthetic peptide
VIHDNFGIVEGLMTTVHAITATQK

SEQ ID NO: 337 - protein, 24 aa, Artificial Sequence
  Description of Artificial Sequence: Synthetic peptide
VIHDNFGIVEGLMTTVHAITATQK

SEQ ID NO: 338 - protein, 21 aa, Artificial Sequence
  Description of Artificial Sequence: Synthetic peptide
VIISAPSADAPMFVMGVNHEK

SEQ ID NO: 339 - protein, 14 aa, Artificial Sequence
  Description of Artificial Sequence: Synthetic peptide
VPTANVSVVDLTCR

SEQ ID NO: 340 - protein, 24 aa, Artificial Sequence
  Description of Artificial Sequence: Synthetic peptide
VIHDNFGIVEGLMTTVHAITATQK

SEQ ID NO: 341 - protein, 24 aa, Artificial Sequence
  Description of Artificial Sequence: Synthetic peptide
VIHDNFGIVEGLMTTVHAITATQK

SEQ ID NO: 342 - protein, 14 aa, Artificial Sequence
  Description of Artificial Sequence: Synthetic peptide
ATIAGGGVIPHIHK

SEQ ID NO: 343 - protein, 29 aa, Artificial Sequence
  Description of Artificial Sequence: Synthetic peptide
VGATAAVYSAAILEYLTAEVLELAGNASK

SEQ ID NO: 344 - protein, 11 aa, Artificial Sequence
  Description of Artificial Sequence: Synthetic peptide
ERNGLSLAALK

SEQ ID NO: 345 - protein, 11 aa, Artificial Sequence
  Description of Artificial Sequence: Synthetic peptide
ERNGLSLAALK

SEQ ID NO: 346 - protein, 12 aa, Artificial Sequence
  Description of Artificial Sequence: Synthetic peptide
ERNGLSLAALKK

SEQ ID NO: 347 - protein, 13 aa, Artificial Sequence
  Description of Artificial Sequence: Synthetic peptide
KATGPPVSELITK

SEQ ID NO: 348 - protein, 16 aa, Artificial Sequence
  Description of Artificial Sequence: Synthetic peptide
SETAPAETATPAPVEK

SEQ ID NO: 349 - protein, 16 aa, Artificial Sequence
  Description of Artificial Sequence: Synthetic peptide
SETAPAETATPAPVEK

SEQ ID NO: 350 - protein, 12 aa, Artificial Sequence
  Description of Artificial Sequence: Synthetic peptide
ERSGVSLAALKK

SEQ ID NO: 351 - protein, 12 aa, Artificial Sequence
  Description of Artificial Sequence: Synthetic peptide
ASGPPVSELITK

SEQ ID NO: 352 - protein, 8 aa, Artificial Sequence
  Description of Artificial Sequence: Synthetic peptide
KAPKSPAK

SEQ ID NO: 353 - protein, 13 aa, Artificial Sequence
  Description of Artificial Sequence: Synthetic peptide
KASGPPVSELITK

SEQ ID NO: 354 - protein, 16 aa, Artificial Sequence
  Description of Artificial Sequence: Synthetic peptide
SETAPAAPAAPAPAEK

SEQ ID NO: 355 - protein, 20 aa, Artificial Sequence
  Description of Artificial Sequence: Synthetic peptide
SETAPAAPAAPAPAEKTPVK

SEQ ID NO: 356 - protein, 21 aa, Artificial Sequence
  Description of Artificial Sequence: Synthetic peptide
SETAPAAPAAPAPAEKTPVKK

SEQ ID NO: 357 - protein, 20 aa, Artificial Sequence
  Description of Artificial Sequence: Synthetic peptide
SETAPAAPAAPAPAEKTPVK

SEQ ID NO: 358 - protein, 22 aa, Artificial Sequence
  Description of Artificial Sequence: Synthetic peptide
SETAPAAPAAPAPAEKTPVKKK

SEQ ID NO: 359 - protein, 20 aa, Artificial Sequence
  Description of Artificial Sequence: Synthetic peptide
SETAPAAPAAPAPAEKTPVK

SEQ ID NO: 360 - protein, 20 aa, Artificial Sequence
  Description of Artificial Sequence: Synthetic peptide
SETAPAAPAAPAPAEKTPVK

SEQ ID NO: 361 - protein, 21 aa, Artificial Sequence
  Description of Artificial Sequence: Synthetic peptide
SETAPAAPAAPAPAEKTPVKK

SEQ ID NO: 362 - protein, 22 aa, Artificial Sequence
  Description of Artificial Sequence: Synthetic peptide
SETAPAAPAAPAPAEKTPVKKK

SEQ ID NO: 363 - protein, 24 aa, Artificial Sequence
  Description of Artificial Sequence: Synthetic peptide
SETAPAAPAAPAPAEKTPVKKKAR

SEQ ID NO: 364 - protein, 25 aa, Artificial Sequence
  Description of Artificial Sequence: Synthetic peptide
SETAPAAPAAPAPAEKTPVKKKARK

SEQ ID NO: 365 - protein, 14 aa, Artificial Sequence
  Description of Artificial Sequence: Synthetic peptide
RKASGPPVSELITK

SEQ ID NO: 366 - protein, 16 aa, Artificial Sequence
  Description of Artificial Sequence: Synthetic peptide
SETAPAAPAAPAPAEK

SEQ ID NO: 367 - protein, 21 aa, Artificial Sequence
  Description of Artificial Sequence: Synthetic peptide
SETAPAAPAAPAPAEKTPVKK

SEQ ID NO: 368 - protein, 9 aa, Artificial Sequence
  Description of Artificial Sequence: Synthetic peptide
SGVSLAALK

SEQ ID NO: 369 - protein, 20 aa, Artificial Sequence
  Description of Artificial Sequence: Synthetic peptide
SETAPAAPAAPAPAEKTPVK

SEQ ID NO: 370 - protein, 21 aa, Artificial Sequence
  Description of Artificial Sequence: Synthetic peptide
SLVSKGTLVQTKGTGASGSFK

SEQ ID NO: 371 - protein, 12 aa, Artificial Sequence
  Description of Artificial Sequence: Synthetic peptide
DNIQGITKPAIR

SEQ ID NO: 372 - protein, 10 aa, Artificial Sequence
  Description of Artificial Sequence: Synthetic peptide
ISGLIYEETR

SEQ ID NO: 373 - protein, 14 aa, Artificial Sequence
  Description of Artificial Sequence: Synthetic peptide
KTVTAMDVVYALKR

SEQ ID NO: 374 - protein, 15 aa, Artificial Sequence
  Description of Artificial Sequence: Synthetic peptide
RISGLIYEETRGVLK

SEQ ID NO: 375 - protein, 15 aa, Artificial Sequence
  Description of Artificial Sequence: Synthetic peptide
RISGLIYEETRGVLK

SEQ ID NO: 376 - protein, 13 aa, Artificial Sequence
  Description of Artificial Sequence: Synthetic peptide
TVTAMDVVYALKR

SEQ ID NO: 377 - protein, 18 aa, Artificial Sequence
  Description of Artificial Sequence: Synthetic peptide
VFLENVIRDAVTYTEHAK

SEQ ID NO: 378 - protein, 8 aa, Artificial Sequence
  Description of Artificial Sequence: Synthetic peptide
VFLENVIR

SEQ ID NO: 379 - protein, 18 aa, Artificial Sequence
  Description of Artificial Sequence: Synthetic peptide
VFLENVIRDAVTYTEHAK

SEQ ID NO: 380 - protein, 13 aa, Artificial Sequence
  Description of Artificial Sequence: Synthetic peptide
TVTAMDVVYALKR

SEQ ID NO: 381 - protein, 13 aa, Artificial Sequence
  Description of Artificial Sequence: Synthetic peptide
KTVTAMDVVYALK

SEQ ID NO: 382 - protein, 14 aa, Artificial Sequence
  Description of Artificial Sequence: Synthetic peptide
KTVTAMDVVYALKR

SEQ ID NO: 383 - protein, 17 aa, Artificial Sequence
  Description of Artificial Sequence: Synthetic peptide
KTVTAMDVVYALKRQGR

SEQ ID NO: 384 - protein, 13 aa, Artificial Sequence
  Description of Artificial Sequence: Synthetic peptide
KTVTAMDVVYALK

SEQ ID NO: 385 - protein, 12 aa, Artificial Sequence
  Description of Artificial Sequence: Synthetic peptide
TVTAMDVVYALK

SEQ ID NO: 386 - protein, 14 aa, Artificial Sequence
  Description of Artificial Sequence: Synthetic peptide
RKTVTAMDVVYALK

SEQ ID NO: 387 - protein, 14 aa, Artificial Sequence
  Description of Artificial Sequence: Synthetic peptide
RKTVTAMDVVYALK

SEQ ID NO: 388 - protein, 15 aa, Artificial Sequence
  Description of Artificial Sequence: Synthetic peptide
RKTVTAMDVVYALKR

SEQ ID NO: 389 - protein, 12 aa, Artificial Sequence
  Description of Artificial Sequence: Synthetic peptide
TVTAMDVVYALK

SEQ ID NO: 390 - protein, 13 aa, Artificial Sequence
  Description of Artificial Sequence: Synthetic peptide
TVTAMDVVYALKR

SEQ ID NO: 391 - protein, 13 aa, Artificial Sequence
  Description of Artificial Sequence: Synthetic peptide
TVTAMDVVYALKR

SEQ ID NO: 392 - protein, 16 aa, Artificial Sequence
  Description of Artificial Sequence: Synthetic peptide
TVTAMDVVYALKRQGR

SEQ ID NO: 393 - protein, 12 aa, Artificial Sequence
  Description of Artificial Sequence: Synthetic peptide
DNIQGITKPAIR

SEQ ID NO: 394 - protein, 13 aa, Artificial Sequence
  Description of Artificial Sequence: Synthetic peptide
KTVTAMDVVYALK

SEQ ID NO: 395 - protein, 13 aa, Artificial Sequence
  Description of Artificial Sequence: Synthetic peptide
KTVTAMDVVYALK

SEQ ID NO: 396 - protein, 14 aa, Artificial Sequence
  Description of Artificial Sequence: Synthetic peptide
KTVTAMDVVYALKR

SEQ ID NO: 397 - protein, 11 aa, Artificial Sequence
  Description of Artificial Sequence: Synthetic peptide
RISGLIYEETR

SEQ ID NO: 398 - protein, 11 aa, Artificial Sequence
  Description of Artificial Sequence: Synthetic peptide
RISGLIYEETR

SEQ ID NO: 399 - protein, 13 aa, Artificial Sequence
  Description of Artificial Sequence: Synthetic peptide
TVTAMDVVYALKR

SEQ ID NO: 400 - protein, 12 aa, Artificial Sequence
  Description of Artificial Sequence: Synthetic peptide
TVTAMDVVYALK

SEQ ID NO: 401 - protein, 12 aa, Artificial Sequence
  Description of Artificial Sequence: Synthetic peptide
TVTAMDVVYALK

SEQ ID NO: 402 - protein, 13 aa, Artificial Sequence
  Description of Artificial Sequence: Synthetic peptide
TVTAMDVVYALKR

SEQ ID NO: 403 - protein, 13 aa, Artificial Sequence
  Description of Artificial Sequence: Synthetic peptide
KTVTAMDVVYALK

SEQ ID NO: 404 - protein, 14 aa, Artificial Sequence
  Description of Artificial Sequence: Synthetic peptide
KTVTAMDVVYALKR

SEQ ID NO: 405 - protein, 12 aa, Artificial Sequence
  Description of Artificial Sequence: Synthetic peptide
TVTAMDVVYALK

SEQ ID NO: 406 - protein, 13 aa, Artificial Sequence
  Description of Artificial Sequence: Synthetic peptide
TVTAMDVVYALKR

SEQ ID NO: 407 - protein, 17 aa, Artificial Sequence
  Description of Artificial Sequence: Synthetic peptide
APWIEQEGPEYWDGETR

SEQ ID NO: 408 - protein, 17 aa, Artificial Sequence
  Description of Artificial Sequence: Synthetic peptide
APWIEQEGPEYWDLQTR

SEQ ID NO: 409 - protein, 17 aa, Artificial Sequence
  Description of Artificial Sequence: Synthetic peptide
APWIEQEGPEYWDQETR

SEQ ID NO: 410 - protein, 14 aa, Artificial Sequence
  Description of Artificial Sequence: Synthetic peptide
APWIEQEGPEYWDR

SEQ ID NO: 411 - protein, 17 aa, Artificial Sequence
  Description of Artificial Sequence: Synthetic peptide
APWIEQERPEYWDQETR

SEQ ID NO: 412 - protein, 12 aa, Artificial Sequence
  Description of Artificial Sequence: Synthetic peptide
AYLEGTCVEWLR

SEQ ID NO: 413 - protein, 17 aa, Artificial Sequence
  Description of Artificial Sequence: Synthetic peptide
CWALGFYPAEITLTWQR

SEQ ID NO: 414 - protein, 24 aa, Artificial Sequence
  Description of Artificial Sequence: Synthetic peptide
DGEDQTQDTELVETRPAGDGTFQK

SEQ ID NO: 415 - protein, 14 aa, Artificial Sequence
  Description of Artificial Sequence: Synthetic peptide
FIAVGYVDDTQFVR

SEQ ID NO: 416 - protein, 14 aa, Artificial Sequence
  Description of Artificial Sequence: Synthetic peptide
FIAVGYVDDTQFVR

SEQ ID NO: 417 - protein, 20 aa, Artificial Sequence
  Description of Artificial Sequence: Synthetic peptide
GYQQDAYDGKDYIALNEDLR

SEQ ID NO: 418 - protein, 16 aa, Artificial Sequence
  Description of Artificial Sequence: Synthetic peptide
THMTHHAVSDHEATLR

SEQ ID NO: 419 - protein, 13 aa, Artificial Sequence
  Description of Artificial Sequence: Synthetic peptide
WAAVVVPSGEEQR

SEQ ID NO: 420 - protein, 13 aa, Artificial Sequence
  Description of Artificial Sequence: Synthetic peptide
WAAVVVPSGQEQR

SEQ ID NO: 421 - protein, 13 aa, Artificial Sequence
  Description of Artificial Sequence: Synthetic peptide
WASVVVPSGQEQR

SEQ ID NO: 422 - protein, 38 aa, Artificial Sequence
  Description of Artificial Sequence: Synthetic polypeptide
WEPSSQPTIPIVGIIAGLVLFGAVITGAVVAAVMWRRK

SEQ ID NO: 423 - protein, 11 aa, Artificial Sequence
  Description of Artificial Sequence: Synthetic peptide
YLENGKETLQR

SEQ ID NO: 424 - protein, 11 aa, Artificial Sequence
  Description of Artificial Sequence: Synthetic peptide
MYGCDVGPDGR

SEQ ID NO: 425 - protein, 11 aa, Artificial Sequence
  Description of Artificial Sequence: Synthetic peptide
MYGCDVGSDWR

SEQ ID NO: 426 - protein, 13 aa, Artificial Sequence
  Description of Artificial Sequence: Synthetic peptide
SWTAADMAAQITK

SEQ ID NO: 427 - protein, 14 aa, Artificial Sequence
  Description of Artificial Sequence: Synthetic peptide
SWTAADMAAQITQR

SEQ ID NO: 428 - protein, 13 aa, Artificial Sequence
  Description of Artificial Sequence: Synthetic peptide
SWTAADMAAQTTK

SEQ ID NO: 429 - protein, 16 aa, Artificial Sequence
  Description of Artificial Sequence: Synthetic peptide
THMTHHAVSDHEATLR

SEQ ID NO: 430 - protein, 16 aa, Artificial Sequence
  Description of Artificial Sequence: Synthetic peptide
THMTHHPISDHEATLR

SEQ ID NO: 431 - protein, 25 aa, Artificial Sequence
  Description of Artificial Sequence: Synthetic peptide
YYNQSEDGSHTIQMMYGCDVGSDGR

SEQ ID NO: 432 - protein, 10 aa, Artificial Sequence
  Description of Artificial Sequence: Synthetic peptide
ETLQRTDAPK

SEQ ID NO: 433 - protein, 10 aa, Artificial Sequence
  Description of Artificial Sequence: Synthetic peptide
MYGCDVGPDR

SEQ ID NO: 434 - protein, 10 aa, Artificial Sequence
  Description of Artificial Sequence: Synthetic peptide
YGCDVGSDGR

SEQ ID NO: 435 - protein, 8 aa, Artificial Sequence
  Description of Artificial Sequence: Synthetic peptide
RYLENGKK

SEQ ID NO: 436 - protein, 12 aa, Artificial Sequence
  Description of Artificial Sequence: Synthetic peptide
RYLENGKETLQR

SEQ ID NO: 437 - protein, 29 aa, Artificial Sequence
  Description of Artificial Sequence: Synthetic peptide
AVMAPRTLLLLLSGALALTQTWAGSHSMR

SEQ ID NO: 438 - protein, 11 aa, Artificial Sequence
  Description of Artificial Sequence: Synthetic peptide
MYGCDVGSDWR

SEQ ID NO: 439 - protein, 23 aa, Artificial Sequence
  Description of Artificial Sequence: Synthetic peptide
TLLLLLSGALALTHTWAGSHSMR

SEQ ID NO: 440 - protein, 17 aa, Artificial Sequence
  Description of Artificial Sequence: Synthetic peptide
EPAVGEPAEVTTTVLVR

SEQ ID NO: 441 - protein, 11 aa, Artificial Sequence
  Description of Artificial Sequence: Synthetic peptide
TFLTVYWTPER

SEQ ID NO: 442 - protein, 25 aa, Artificial Sequence
  Description of Artificial Sequence: Synthetic peptide
TFLTVYWTPERVELAPLPSWQPVGK

SEQ ID NO: 443 - protein, 14 aa, Artificial Sequence
  Description of Artificial Sequence: Synthetic peptide
VTLNGVPAQPLGPR

SEQ ID NO: 444 - protein, 13 aa, Artificial Sequence
  Description of Artificial Sequence: Synthetic peptide
GTPMKPNTQATPP

SEQ ID NO: 445 - protein, 32 aa, Artificial Sequence
  Description of Artificial Sequence: Synthetic polypeptide
DCPGNWTWPENSQQTPMCQAWGNPLPELKCLK

SEQ ID NO: 446 - protein, 16 aa, Artificial Sequence
  Description of Artificial Sequence: Synthetic peptide
GGSVLVTCSTSCDQPK

SEQ ID NO: 447 - protein, 24 aa, Artificial Sequence
  Description of Artificial Sequence: Synthetic peptide
SAGCGCCPMCALPLGAACGVATAR

SEQ ID NO: 448 - protein, 11 aa, Artificial Sequence
  Description of Artificial Sequence: Synthetic peptide
AQETSGEEISK

SEQ ID NO: 449 - protein, 25 aa, Artificial Sequence
  Description of Artificial Sequence: Synthetic peptide
KWKCETSMDGEAGLCWCVYPWNGKR

SEQ ID NO: 450 - protein, 30 aa, Artificial Sequence
  Description of Artificial Sequence: Synthetic polypeptide
ASTKGPSVFPLAPCSRSTSESTAALGCLVK

SEQ ID NO: 451 - protein, 7 aa, Artificial Sequence
  Description of Artificial Sequence: Synthetic peptide
DTLMISR

SEQ ID NO: 452 - protein, 22 aa, Artificial Sequence
  Description of Artificial Sequence: Synthetic peptide
DTLMISRTPEVTCVVVDVSHED

SEQ ID NO: 453 - protein, 40 aa, Artificial Sequence
  Description of Artificial Sequence: Synthetic polypeptide
DTLMISRTPEVTCVVVDVSHEDPEVQFNWYVDGVEVHNAK

SEQ ID NO: 454 - protein, 40 aa, Artificial Sequence; identical to SEQ ID NO: 453
  Description of Artificial Sequence: Synthetic polypeptide

SEQ ID NO: 455 - protein, 40 aa, Artificial Sequence; identical to SEQ ID NO: 453
  Description of Artificial Sequence: Synthetic polypeptide

SEQ ID NO: 456 - protein, 40 aa, Artificial Sequence; identical to SEQ ID NO: 453
  Description of Artificial Sequence: Synthetic polypeptide

SEQ ID NO: 457 - protein, 26 aa, Artificial Sequence
  Description of Artificial Sequence: Synthetic peptide
GPSVFPLAPCSRSTSESTAALGCLVK

SEQ ID NO: 458 - protein, 20 aa, Artificial Sequence
  Description of Artificial Sequence: Synthetic peptide
GQPREPQVYTLPPSREEMTK

SEQ ID NO: 459 - protein, 20 aa, Artificial Sequence
  Description of Artificial Sequence: Synthetic peptide
GQPREPQVYTLPPSREEMTK

SEQ ID NO: 460 - protein, 20 aa, Artificial Sequence
  Description of Artificial Sequence: Synthetic peptide
GQPREPQVYTLPPSREEMTK

SEQ ID NO: 461 - protein, 20 aa, Artificial Sequence
  Description of Artificial Sequence: Synthetic peptide
GQPREPQVYTLPPSREEMTK

SEQ ID NO: 462 - protein, 30 aa, Artificial Sequence
  Description of Artificial Sequence: Synthetic polypeptide
GQPREPQVYTLPPSREEMTKNQVSLTCLVK

SEQ ID NO: 463 - protein, 20 aa, Artificial Sequence
  Description of Artificial Sequence: Synthetic peptide
GQPREPQVYTLPPSREEMTK

SEQ ID NO: 464 - protein, 30 aa, Artificial Sequence; identical to SEQ ID NO: 462
  Description of Artificial Sequence: Synthetic polypeptide

SEQ ID NO: 465 - protein, 20 aa, Artificial Sequence
  Description of Artificial Sequence: Synthetic peptide
GQPREPQVYTLPPSREEMTK

SEQ ID NO: 466 - protein, 25 aa, Artificial Sequence
  Description of Artificial Sequence: Synthetic peptide
SRWQQGNVFSCSVMHEALHNHYTQK

SEQ ID NO: 467 - protein, 25 aa, Artificial Sequence
  Description of Artificial Sequence: Synthetic peptide
SRWQQGNVFSCSVMHEALHNHYTQK

SEQ ID NO: 468 - protein, 25 aa, Artificial Sequence
  Description of Artificial Sequence: Synthetic peptide
SRWQQGNVFSCSVMHEALHNHYTQK

SEQ ID NO: 469 - protein, 40 aa, Artificial Sequence; identical to SEQ ID NO: 453
  Description of Artificial Sequence: Synthetic polypeptide

SEQ ID NO: 470 - protein, 20 aa, Artificial Sequence
  Description of Artificial Sequence: Synthetic peptide
GQPREPQVYTLPPSREEMTK

SEQ ID NO: 471 - protein, 30 aa, Artificial Sequence; identical to SEQ ID NO: 462
  Description of Artificial Sequence: Synthetic polypeptide

SEQ ID NO: 472 - protein, 20 aa, Artificial Sequence
  Description of Artificial Sequence: Synthetic peptide
GQPREPQVYTLPPSREEMTK

SEQ ID NO: 473 - protein, 30 aa, Artificial Sequence; identical to SEQ ID NO: 462
  Description of Artificial Sequence: Synthetic polypeptide

SEQ ID NO: 474 - protein, 20 aa, Artificial Sequence
  Description of Artificial Sequence: Synthetic peptide
GQPREPQVYTLPPSREEMTK

SEQ ID NO: 475 - protein, 20 aa, Artificial Sequence
  Description of Artificial Sequence: Synthetic peptide
GQPREPQVYTLPPSREEMTK

SEQ ID NO: 476 - protein, 30 aa, Artificial Sequence; identical to SEQ ID NO: 462
  Description of Artificial Sequence: Synthetic polypeptide

SEQ ID NO: 477 - protein, 30 aa, Artificial Sequence; identical to SEQ ID NO: 462
  Description of Artificial Sequence: Synthetic polypeptide

SEQ ID NO: 478 - protein, 25 aa, Artificial Sequence
  Description of Artificial Sequence: Synthetic peptide
SRWQQGNVFSCSVMHEALHNHYTQK

SEQ ID NO: 479 - protein, 25 aa, Artificial Sequence
  Description of Artificial Sequence: Synthetic peptide
SRWQQGNVFSCSVMHEALHNHYTQK

SEQ ID NO: 480 - protein, 7 aa, Artificial Sequence
  Description of Artificial Sequence: Synthetic peptide
DTLMISR

SEQ ID NO: 481 - protein, 16 aa, Artificial Sequence
  Description of Artificial Sequence: Synthetic peptide
EPQVYTLPPSREEMTK

SEQ ID NO: 482 - protein, 16 aa, Artificial Sequence
  Description of Artificial Sequence: Synthetic peptide
EPQVYTLPPSREEMTK

SEQ ID NO: 483 - protein, 16 aa, Artificial Sequence
  Description of Artificial Sequence: Synthetic peptide
EPQVYTLPPSREEMTK

SEQ ID NO: 484 - protein, 30 aa, Artificial Sequence; identical to SEQ ID NO: 462
  Description of Artificial Sequence: Synthetic polypeptide

SEQ ID NO: 485 - protein, 20 aa, Artificial Sequence
  Description of Artificial Sequence: Synthetic peptide
GQPREPQVYTLPPSREEMTK

SEQ ID NO: 486 - protein, 30 aa, Artificial Sequence; identical to SEQ ID NO: 462
  Description of Artificial Sequence: Synthetic polypeptide

SEQ ID NO: 487 - protein, 20 aa, Artificial Sequence
  Description of Artificial Sequence: Synthetic peptide
GQPREPQVYTLPPSREEMTK

SEQ ID NO: 488 - protein, 30 aa, Artificial Sequence; identical to SEQ ID NO: 462
  Description of Artificial Sequence: Synthetic polypeptide

SEQ ID NO: 489 - protein, 30 aa, Artificial Sequence; identical to SEQ ID NO: 462
  Description of Artificial Sequence: Synthetic polypeptide

SEQ ID NO: 490 - protein, 30 aa, Artificial Sequence; identical to SEQ ID NO: 462
  Description of Artificial Sequence: Synthetic polypeptide

SEQ ID NO: 491 - protein, 25 aa, Artificial Sequence
  Description of Artificial Sequence: Synthetic peptide
SRWQQGNVFSCSVMHEALHNHYTQK

SEQ ID NO: 492 - protein, 25 aa, Artificial Sequence
  Description of Artificial Sequence: Synthetic peptide
SRWQQGNVFSCSVMHEALHNHYTQK

SEQ ID NO: 493 - protein, 25 aa, Artificial Sequence
  Description of Artificial Sequence: Synthetic peptide
SRWQQGNVFSCSVMHEALHNHYTQK

SEQ ID NO: 494 - protein, 25 aa, Artificial Sequence
  Description of Artificial Sequence: Synthetic peptide
SRWQQGNVFSCSVMHEALHNHYTQK

SEQ ID NO: 495 - protein, 25 aa, Artificial Sequence
  Description of Artificial Sequence: Synthetic peptide
SRWQQGNVFSCSVMHEALHNHYTQK

SEQ ID NO: 496 - protein, 25 aa, Artificial Sequence
  Description of Artificial Sequence: Synthetic peptide
SRWQQGNVFSCSVMHEALHNHYTQK

SEQ ID NO: 497 - protein, 25 aa, Artificial Sequence
  Description of Artificial Sequence: Synthetic peptide
SRWQQGNVFSCSVMHEALHNHYTQK

SEQ ID NO: 498 - protein, 25 aa, Artificial Sequence
  Description of Artificial Sequence: Synthetic peptide
SRWQQGNVFSCSVMHEALHNHYTQK

SEQ ID NO: 499 - protein, 25 aa, Artificial Sequence
  Description of Artificial Sequence: Synthetic peptide
SRWQQGNVFSCSVMHEALHNHYTQK

SEQ ID NO: 500 - protein, 25 aa, Artificial Sequence
  Description of Artificial Sequence: Synthetic peptide
SRWQQGNVFSCSVMHEALHNHYTQK

SEQ ID NO: 501 - protein, 25 aa, Artificial Sequence
  Description of Artificial Sequence: Synthetic peptide
SRWQQGNVFSCSVMHEALHNHYTQK

SEQ ID NO: 502 - protein, 17 aa, Artificial Sequence
  Description of Artificial Sequence: Synthetic peptide
TTPPMLDSDGSFFLYSK

SEQ ID NO: 503 - protein, 23 aa, Artificial Sequence
  Description of Artificial Sequence: Synthetic peptide
WQQGNVFSCSVMHEALHNHYTQK

SEQ ID NO: 504 - protein, 11 aa, Artificial Sequence
  Description of Artificial Sequence: Synthetic peptide
QMILNGINNYK

SEQ ID NO: 505 - protein, 11 aa, Artificial Sequence
  Description of Artificial Sequence: Synthetic peptide
QMILNGINNYK

SEQ ID NO: 506 - protein, 11 aa, Artificial Sequence
  Description of Artificial Sequence: Synthetic peptide
QMILNGINNYK

SEQ ID NO: 507 - protein, 11 aa, Artificial Sequence
  Description of Artificial Sequence: Synthetic peptide
QMILNGINNYK

SEQ ID NO: 508 - protein, 23 aa, Artificial Sequence
  Description of Artificial Sequence: Synthetic peptide
CDYWIRTFVPGCQPGEFTLGNIK

SEQ ID NO: 509 - protein, 16 aa, Artificial Sequence
  Description of Artificial Sequence: Synthetic peptide
WYVVGLAGNAILREDK

SEQ ID NO: 510 - protein, 13 aa, Artificial Sequence
  Description of Artificial Sequence: Synthetic peptide
WYVVGLAGNAILR

SEQ ID NO: 511 - protein, 9 aa, Artificial Sequence
  Description of Artificial Sequence: Synthetic peptide
MYATIYELK

SEQ ID NO: 512 - protein, 12 aa, Artificial Sequence
  Description of Artificial Sequence: Synthetic peptide
MYATIYELKEDK

SEQ ID NO: 513 - protein, 15 aa, Artificial Sequence
  Description of Artificial Sequence: Synthetic peptide
VVSTNYNQHAMVFFK

SEQ ID NO: 514 - protein, 30 aa, Artificial Sequence
  Description of Artificial Sequence: Synthetic polypeptide
CVPNSNERYYGYTGAFRCLAENAGDVAFVK

SEQ ID NO: 515 - protein, 30 aa, Artificial Sequence; identical to SEQ ID NO: 514
  Description of Artificial Sequence: Synthetic polypeptide

SEQ ID NO: 516 - protein, 30 aa, Artificial Sequence; identical to SEQ ID NO: 514
  Description of Artificial Sequence: Synthetic polypeptide

SEQ ID NO: 517 - protein, 30 aa, Artificial Sequence; identical to SEQ ID NO: 514
  Description of Artificial Sequence: Synthetic polypeptide

SEQ ID NO: 518 - protein, 30 aa, Artificial Sequence; identical to SEQ ID NO: 514
  Description of Artificial Sequence: Synthetic polypeptide

SEQ ID NO: 519 - protein, 30 aa, Artificial Sequence; identical to SEQ ID NO: 514
  Description of Artificial Sequence: Synthetic polypeptide

SEQ ID NO: 520 - protein, 30 aa, Artificial Sequence; identical to SEQ ID NO: 514
  Description of Artificial Sequence: Synthetic polypeptide

SEQ ID NO: 521 - protein, 34 aa, Artificial Sequence
  Description of Artificial Sequence: Synthetic polypeptide
DCHLARVPSHAVVARSVNGKEDAIWNLLRQAQEK

SEQ ID NO: 522 - protein, 34 aa, Artificial Sequence; identical to SEQ ID NO: 521
  Description of Artificial Sequence: Synthetic polypeptide

SEQ ID NO: 523 - protein, 32 aa, Artificial Sequence
  Description of Artificial Sequence: Synthetic polypeptide
DSAIGFSRVPPRIDSGLYLGSGYFTAIQNLRK

SEQ ID NO: 524 - protein, 32 aa, Artificial Sequence; identical to SEQ ID NO: 523
  Description of Artificial Sequence: Synthetic polypeptide

SEQ ID NO: 525 - protein, 32 aa, Artificial Sequence; identical to SEQ ID NO: 523
  Description of Artificial Sequence: Synthetic polypeptide

SEQ ID NO: 526 - protein, 32 aa, Artificial Sequence; identical to SEQ ID NO: 523
  Description of Artificial Sequence: Synthetic polypeptide

SEQ ID NO: 527 - protein, 32 aa, Artificial Sequence; identical to SEQ ID NO: 523
  Description of Artificial Sequence: Synthetic polypeptide

SEQ ID NO: 528 - protein, 32 aa, Artificial Sequence; identical to SEQ ID NO: 523
  Description of Artificial Sequence: Synthetic polypeptide

SEQ ID NO: 529 - protein, 32 aa, Artificial Sequence; identical to SEQ ID NO: 523
  Description of Artificial Sequence: Synthetic polypeptide

SEQ ID NO: 530 - protein, 26 aa, Artificial Sequence
  Description of Artificial Sequence: Synthetic peptide
ESTVFEDLSDEAERDEYELLCPDNTR

SEQ ID NO: 531 - protein, 32 aa, Artificial Sequence
  Description of Artificial Sequence: Synthetic polypeptide
FDEYFSQSCAPGSDPRSNLCALCIGDEQGENK

SEQ ID NO: 532 - protein, 11 aa, Artificial Sequence
  Description of Artificial Sequence: Synthetic peptide
FGRNGSDCPDK

SEQ ID NO: 533 - protein, 11 aa, Artificial Sequence
  Description of Artificial Sequence: Synthetic peptide
FGRNGSDCPDK

SEQ ID NO: 534 - protein, 13 aa, Artificial Sequence
  Description of Artificial Sequence: Synthetic peptide
LRPVAAEVYGTER

SEQ ID NO: 535 - protein, 13 aa, Artificial Sequence
  Description of Artificial Sequence: Synthetic peptide
NLLFNDNTECLAR

SEQ ID NO: 536 - protein, 17 aa, Artificial Sequence
  Description of Artificial Sequence: Synthetic peptide
NLLFNDNTECLARLHGK

SEQ ID NO: 537 - protein, 12 aa, Artificial Sequence
  Description of Artificial Sequence: Synthetic peptide
RSDTSLTWNSVK

SEQ ID NO: 538 - protein, 26 aa, Artificial Sequence
  Description of Artificial Sequence: Synthetic peptide
RKPVTEARSCHLAMAPNHAVVSRMDK

SEQ ID NO: 539 - protein, 26 aa, Artificial Sequence
  Description of Artificial Sequence: Synthetic peptide
SQQSSDPDPNCVDRPVEGYLAVAVVR

SEQ ID NO: 540 - protein, 26 aa, Artificial Sequence
  Description of Artificial Sequence: Synthetic peptide
SQQSSDPDPNCVDRPVEGYLAVAVVR

SEQ ID NO: 541 - protein, 26 aa, Artificial Sequence
  Description of Artificial Sequence: Synthetic peptide
SQQSSDPDPNCVDRPVEGYLAVAVVR

SEQ ID NO: 542 - protein, 23 aa, Artificial Sequence
  Description of Artificial Sequence: Synthetic peptide
VPPRIDSGLYLGSGYFTAIQNLR

SEQ ID NO: 543 - protein, 10 aa, Artificial Sequence
  Description of Artificial Sequence: Synthetic peptide
VRGPPVSCIK

SEQ ID NO: 544 - protein, 12 aa, Artificial Sequence
  Description of Artificial Sequence: Synthetic peptide
VVWCAVGEQELR

SEQ ID NO: 545 - protein, 13 aa, Artificial Sequence
  Description of Artificial Sequence: Synthetic peptide
VVWCAVGEQELRK

SEQ ID NO: 546 - protein, 18 aa, Artificial Sequence
  Description of Artificial Sequence: Synthetic peptide
GEADAMSLDGGYVYTAGK

SEQ ID NO: 547 - protein, 26 aa, Artificial Sequence
  Description of Artificial Sequence: Synthetic peptide
RKPVTEARSCHLAMAPNHAVVSRMDK

SEQ ID NO: 548 - protein, 26 aa, Artificial Sequence
  Description of Artificial Sequence: Synthetic peptide
RKPVTEARSCHLAMAPNHAVVSRMDK

SEQ ID NO: 549 - protein, 26 aa, Artificial Sequence
  Description of Artificial Sequence: Synthetic peptide
RKPVTEARSCHLAMAPNHAVVSRMDK

SEQ ID NO: 550 - protein, 15 aa, Artificial Sequence
  Description of Artificial Sequence: Synthetic peptide
SCHLAMAPNHAVVSR

SEQ ID NO: 551 - protein, 19 aa, Artificial Sequence
  Description of Artificial Sequence: Synthetic peptide
TAGWNIPMGLLFNQTGSCK

SEQ ID NO: 552 - protein, 9 aa, Artificial Sequence
  Description of Artificial Sequence: Synthetic peptide
YYGYTGAFR

SEQ ID NO: 553 - protein, 17 aa, Artificial Sequence
  Description of Artificial Sequence: Synthetic peptide
GLKSLEYLDLSFNQIAR

SEQ ID NO: 554 - protein, 29 aa, Artificial Sequence
  Description of Artificial Sequence: Synthetic peptide
LPSGLPVSLLTLYLDNNKISNIPDEYFKR

SEQ ID NO: 555 - protein, 15 aa, Artificial Sequence
  Description of Artificial Sequence: Synthetic peptide
ISETSLPPDMYECLR

SEQ ID NO: 556 - protein, 10 aa, Artificial Sequence
  Description of Artificial Sequence: Synthetic peptide
SVPMVPPGIK

SEQ ID NO: 557 - protein, 8 aa, Artificial Sequence
  Description of Artificial Sequence: Synthetic peptide
FNALQYLR

SEQ ID NO: 558 - protein, 7 aa, Artificial Sequence
  Description of Artificial Sequence: Synthetic peptide
LDLSYNK

SEQ ID NO: 559 - protein, 8 aa, Artificial Sequence
  Description of Artificial Sequence: Synthetic peptide
VANEVTLN

SEQ ID NO: 560 - protein, 22 aa, Artificial Sequence
  Description of Artificial Sequence: Synthetic peptide
GICEALEDSDGRQDSPAGELPK

SEQ ID NO: 561 - protein, 22 aa, Artificial Sequence
  Description of Artificial Sequence: Synthetic peptide
GICEALEDSDGRQDSPAGELPK

SEQ ID NO: 562 - protein, 23 aa, Artificial Sequence
  Description of Artificial Sequence: Synthetic peptide
KGICEALEDSDGRQDSPAGELPK

SEQ ID NO: 563 - protein, 17 aa, Artificial Sequence
  Description of Artificial Sequence: Synthetic peptide
CENLIMFQNLANEEVRK

SEQ ID NO: 564 - protein, 24 aa, Artificial Sequence
  Description of Artificial Sequence: Synthetic peptide
TCSRVDYCLLSDHGCEYSCVNMDR

SEQ ID NO: 565 - protein, 24 aa, Artificial Sequence
  Description of Artificial Sequence: Synthetic peptide
TCSRVDYCLLSDHGCEYSCVNMDR

SEQ ID NO: 566 - protein, 20 aa, Artificial Sequence
  Description of Artificial Sequence: Synthetic peptide
VIMIVTDGRPQDSVAEVAAK

SEQ ID NO: 567 - protein, 31 aa, Artificial Sequence
  Description of Artificial Sequence: Synthetic polypeptide
KLCTAHMCSTLEHNCAHFCINIPGSYVCRCK

SEQ ID NO: 568 - protein, 26 aa, Artificial Sequence
  Description of Artificial Sequence: Synthetic peptide
RINYCALNKPGCEHECVNMEESYYCR

SEQ ID NO: 569 - protein, 15 aa, Artificial Sequence
  Description of Artificial Sequence: Synthetic peptide
VEADIPGHGQEVLIR

SEQ ID NO: 570 - protein, 18 aa, Artificial Sequence
  Description of Artificial Sequence: Synthetic peptide
VEADIPGHGQEVLIRLFK

SEQ ID NO: 571 - protein, 20 aa, Artificial Sequence
  Description of Artificial Sequence: Synthetic peptide
ALELFRKDMASNYKELGFQG

SEQ ID NO: 572 - protein, 7 aa, Artificial Sequence
  Description of Artificial Sequence: Synthetic peptide
DMASNYK

SEQ ID NO: 573 - protein, 13 aa, Artificial Sequence
  Description of Artificial Sequence: Synthetic peptide
DMASNYKELGFQG

SEQ ID NO: 574 - protein, 11 aa, Artificial Sequence
  Description of Artificial Sequence: Synthetic peptide
FKHLKSEDEMK

SEQ ID NO: 575 - protein, 9 aa, Artificial Sequence
  Description of Artificial Sequence: Synthetic peptide
HLKSEDEMK

SEQ ID NO: 576 - protein, 15 aa, Artificial Sequence
  Description of Artificial Sequence: Synthetic peptide
HLKSEDEMKASEDLK

SEQ ID NO: 577 - protein, 15 aa, Artificial Sequence
  Description of Artificial Sequence: Synthetic peptide
HPGDFGADAQGAMNK

SEQ ID NO: 578 - protein, 8 aa, Artificial Sequence
  Description of Artificial Sequence: Synthetic peptide
KDMASNYK

SEQ ID NO: 579 - protein, 14 aa, Artificial Sequence
  Description of Artificial Sequence: Synthetic peptide
KDMASNYKELGFQG

SEQ ID NO: 580 - protein, 9 aa, Artificial Sequence
  Description of Artificial Sequence: Synthetic peptide
MKASEDLKK

SEQ ID NO: 581 - protein, 12 aa, Artificial Sequence
  Description of Artificial Sequence: Synthetic peptide
SEDEMKASEDLK

SEQ ID NO: 582 - protein, 13 aa, Artificial Sequence
  Description of Artificial Sequence: Synthetic peptide
SEDEMKASEDLKK

SEQ ID NO: 583 - protein, 16 aa, Artificial Sequence
  Description of Artificial Sequence: Synthetic peptide
YLEFISECIIQVLQSK

SEQ ID NO: 584 - protein, 16 aa, Artificial Sequence
  Description of Artificial Sequence: Synthetic peptide
YLEFISECIIQVLQSK

SEQ ID NO: 585 - protein, 27 aa, Artificial Sequence
  Description of Artificial Sequence: Synthetic peptide
EYSTCTSEGRGDGRLWCATTSNFDSDK

SEQ ID NO: 586 - protein, 18 aa, Artificial Sequence
  Description of Artificial Sequence: Synthetic peptide
FGNADGAACHFPFIFEGR

SEQ ID NO: 587 - protein, 19 aa, Artificial Sequence
  Description of Artificial Sequence: Synthetic peptide
GSRPQGPFLIADKWPALPR

SEQ ID NO: 588 - protein, 32 aa, Artificial Sequence
  Description of Artificial Sequence: Synthetic polypeptide
LFGFCPTRADSTVMGGNSAGELCVFPFTFLGK

SEQ ID NO: 589 - protein, 20 aa, Artificial Sequence
  Description of Artificial Sequence: Synthetic peptide
LGLGADVAQVTGALRSGRGK

SEQ ID NO: 590 - protein, 20 aa, Artificial Sequence
  Description of Artificial Sequence: Synthetic peptide
LGLGADVAQVTGALRSGRGK

SEQ ID NO: 591 - protein, 7 aa, Artificial Sequence
  Description of Artificial Sequence: Synthetic peptide
MLLFSGR

SEQ ID NO: 592 - protein, 18 aa, Artificial Sequence
  Description of Artificial Sequence: Synthetic peptide
FCGLPQPETVGQLGTVLR

SEQ ID NO: 593 - protein, 12 aa, Artificial Sequence
  Description of Artificial Sequence: Synthetic peptide
FPTDQLTPDQER

SEQ ID NO: 594 - protein, 17 aa, Artificial Sequence
  Description of Artificial Sequence: Synthetic peptide
GRVGPLLACIIGTQFRK

SEQ ID NO: 595 - protein, 10 aa, Artificial Sequence
  Description of Artificial Sequence: Synthetic peptide
IANVFTNAFR

SEQ ID NO: 596 - protein, 10 aa, Artificial Sequence
  Description of Artificial Sequence: Synthetic peptide
IPCFLAGDTR

SEQ ID NO: 597 - protein, 24 aa, Artificial Sequence
  Description of Artificial Sequence: Synthetic peptide
NQINALTSFVDASMVYGSEEPLAR

SEQ ID NO: 598 - protein, 14 aa, Artificial Sequence
  Description of Artificial Sequence: Synthetic peptide
VGPLLACIIGTQFR

SEQ ID NO: 599 - skipped

SEQ ID NO: 600 - protein, 18 aa, Artificial Sequence
  Description of Artificial Sequence: Synthetic peptide
DGDRFWWENEGVFSMQQR

SEQ ID NO: 601 - protein, 14 aa, Artificial Sequence
  Description of Artificial Sequence: Synthetic peptide
FWWENEGVFSMQQR

SEQ ID NO: 602 - protein, 18 aa, Artificial Sequence
  Description of Artificial Sequence: Synthetic peptide
DGDRFWWENEGVFSMQQR

SEQ ID NO: 603 - protein, 13 aa, Artificial Sequence
  Description of Artificial Sequence: Synthetic peptide
DYLPLVLGPTAMR

SEQ ID NO: 604 - protein, 14 aa, Artificial Sequence
  Description of Artificial Sequence: Synthetic peptide
FWWENEGVFSMQQR

SEQ ID NO: 605 - protein, 22 aa, Artificial Sequence
  Description of Artificial Sequence: Synthetic peptide
IANVFTNAFRYGHTLIQPFMFR

SEQ ID NO: 606 - protein, 12 aa, Artificial Sequence
  Description of Artificial Sequence: Synthetic peptide
IGLDLPALNMQR

SEQ ID NO: 607 - protein, 12 aa, Artificial Sequence
  Description of Artificial Sequence: Synthetic peptide
IVGAMVQIITYR

SEQ ID NO: 608 - protein, 24 aa, Artificial Sequence
  Description of Artificial Sequence: Synthetic peptide
KLMEQYGTPNNIDIWMGGVSEPLK

SEQ ID NO: 609 - protein, 7 aa, Artificial Sequence
  Description of Artificial Sequence: Synthetic peptide
LFEQVMR

SEQ ID NO: 610 - protein, 23 aa, Artificial Sequence
  Description of Artificial Sequence: Synthetic peptide
LMEQYGTPNNIDIWMGGVSEPLK

SEQ ID NO: 611 - protein, 23 aa, Artificial Sequence
  Description of Artificial Sequence: Synthetic peptide
LMEQYGTPNNIDIWMGGVSEPLK

SEQ ID NO: 612 - protein, 23 aa, Artificial Sequence
  Description of Artificial Sequence: Synthetic peptide
LMEQYGTPNNIDIWMGGVSEPLK

SEQ ID NO: 613 - protein, 23 aa, Artificial Sequence
  Description of Artificial Sequence: Synthetic peptide
LMEQYGTPNNIDIWMGGVSEPLK

SEQ ID NO: 614 - protein, 23 aa, Artificial Sequence
  Description of Artificial Sequence: Synthetic peptide
LMEQYGTPNNIDIWMGGVSEPLK

SEQ ID NO: 615 - protein, 23 aa, Artificial Sequence
  Description of Artificial Sequence: Synthetic peptide
LMEQYGTPNNIDIWMGGVSEPLK

SEQ ID NO: 616 - protein, 23 aa, Artificial Sequence
  Description of Artificial Sequence: Synthetic peptide
LMEQYGTPNNIDIWMGGVSEPLK

SEQ ID NO: 617 - protein, 24 aa, Artificial Sequence
  Description of Artificial Sequence: Synthetic peptide
LMEQYGTPNNIDIWMGGVSEPLKR

SEQ ID NO: 618 - protein, 23 aa, Artificial Sequence
  Description of Artificial Sequence: Synthetic peptide
LMEQYGTPNNIDIWMGGVSEPLK

SEQ ID NO: 619 - protein, 23 aa, Artificial Sequence
  Description of Artificial Sequence: Synthetic peptide
LMEQYGTPNNIDIWMGGVSEPLK

SEQ ID NO: 620 - protein, 23 aa, Artificial Sequence
  Description of Artificial Sequence: Synthetic peptide
LMEQYGTPNNIDIWMGGVSEPLK

SEQ ID NO: 621 - protein, 23 aa, Artificial Sequence
  Description of Artificial Sequence: Synthetic peptide
LMEQYGTPNNIDIWMGGVSEPLK

SEQ ID NO: 622 - protein, 23 aa, Artificial Sequence
  Description of Artificial Sequence: Synthetic peptide
LMEQYGTPNNIDIWMGGVSEPLK

SEQ ID NO: 623 - protein, 24 aa, Artificial Sequence
  Description of Artificial Sequence: Synthetic peptide
LMEQYGTPNNIDIWMGGVSEPLKR

SEQ ID NO: 624 - protein, 11 aa, Artificial Sequence
  Description of Artificial Sequence: Synthetic peptide
NNIFMSNSYPR

SEQ ID NO: 625 - protein, 31 aa, Artificial Sequence
  Description of Artificial Sequence: Synthetic polypeptide
NNIFMSNSYPRDFVNCSTLPALNLASWREAS

SEQ ID NO: 626 - protein, 11 aa, Artificial Sequence
  Description of Artificial Sequence: Synthetic peptide
NNIFMSNSYPR

SEQ ID NO: 627 - protein, 24 aa, Artificial Sequence
  Description of Artificial Sequence: Synthetic peptide
NQINALTSFVDASMVYGSEEPLAR

SEQ ID NO: 628 - protein, 24 aa, Artificial Sequence
  Description of Artificial Sequence: Synthetic peptide
SLMFMQWGQLLDHDLDFTPEPAAR

SEQ ID NO: 629 - protein, 24 aa, Artificial Sequence
  Description of Artificial Sequence: Synthetic peptide
SLMFMQWGQLLDHDLDFTPEPAAR

SEQ ID NO: 630 - protein, 24 aa, Artificial Sequence
  Description of Artificial Sequence: Synthetic peptide
SLMFMQWGQLLDHDLDFTPEPAAR

SEQ ID NO: 631 - protein, 16 aa, Artificial Sequence
  Description of Artificial Sequence: Synthetic peptide
SSEMPELTSMHTLLLR

SEQ ID NO: 632 - protein, 9 aa, Artificial Sequence
  Description of Artificial Sequence: Synthetic peptide
TITGMCNNR

SEQ ID NO: 633 - protein, 9 aa, Artificial Sequence
  Description of Artificial Sequence: Synthetic peptide
YQPMEPNPR

SEQ ID NO: 634 - protein, 13 aa, Artificial Sequence
  Description of Artificial Sequence: Synthetic peptide
KIVGAMVQIITYR

SEQ ID NO: 635 - protein, 28 aa, Artificial Sequence
  Description of Artificial Sequence: Synthetic peptide
MGVPFFSSLRCMVDLGPCWAGGLTAEMK

SEQ ID NO: 636 - protein, 24 aa, Artificial Sequence
  Description of Artificial Sequence: Synthetic peptide
SLMFMQWGQLLDHDLDFTPEPAAR

SEQ ID NO: 637 - protein, 15 aa, Artificial Sequence
  Description of Artificial Sequence: Synthetic peptide
AERNYHIFYQILSNK

SEQ ID NO: 638 - protein, 13 aa, Artificial Sequence
  Description of Artificial Sequence: Synthetic peptide
KLAEQELIETSER

SEQ ID NO: 639 - protein, 10 aa, Artificial Sequence
  Description of Artificial Sequence: Synthetic peptide
LQTENGELAR

SEQ ID NO: 640 - protein, 14 aa, Artificial Sequence
  Description of Artificial Sequence: Synthetic peptide
VIQYFASIAAIGDR

SEQ ID NO: 641 - protein, 14 aa, Artificial Sequence
  Description of Artificial Sequence: Synthetic peptide
VVDSLQTSLDAETR

SEQ ID NO: 642 - protein, 23 aa, Artificial Sequence
  Description of Artificial Sequence: Synthetic peptide
CIIPNERKAPGVMDNPLVMHQLR

SEQ ID NO: 643 - protein, 23 aa, Artificial Sequence
  Description of Artificial Sequence: Synthetic peptide
CIIPNERKAPGVMDNPLVMHQLR

SEQ ID NO: 644 - protein, 14 aa, Artificial Sequence
  Description of Artificial Sequence: Synthetic peptide
LQNEIEDLMVDVER

SEQ ID NO: 645 - protein, 12 aa, Artificial Sequence
  Description of Artificial Sequence: Synthetic peptide
AFMGVKNWPWMK

SEQ ID NO: 646 - protein, 8 aa, Artificial Sequence
  Description of Artificial Sequence: Synthetic peptide
DEEMEQAK

SEQ ID NO: 647 - protein, 11 aa, Artificial Sequence
  Description of Artificial Sequence: Synthetic peptide
EDQVMQQNPPK

SEQ ID NO: 648 - protein, 21 aa, Artificial Sequence
  Description of Artificial Sequence: Synthetic peptide
EKSEFKLELDDVTSNMEQIIK

SEQ ID NO: 649 - protein, 25 aa, Artificial Sequence
  Description of Artificial Sequence: Synthetic peptide
ELEEISERLEEAGGATSVQIEMNKK

SEQ ID NO: 650 - protein, 16 aa, Artificial Sequence
  Description of Artificial Sequence: Synthetic peptide
HRLQNEIEDLMVDVER

SEQ ID NO: 651 - protein, 20 aa, Artificial Sequence
  Description of Artificial Sequence: Synthetic peptide
IEDMAMLTFLHEPAVLFNLK

SEQ ID NO: 652 - protein, 20 aa, Artificial Sequence
  Description of Artificial Sequence: Synthetic peptide
IEDMAMLTFLHEPAVLFNLK

SEQ ID NO: 653 - protein, 16 aa, Artificial Sequence
  Description of Artificial Sequence: Synthetic peptide
KAPGVMDNPLVMHQLR

SEQ ID NO: 654 - protein, 16 aa, Artificial Sequence
  Description of Artificial Sequence: Synthetic peptide
KAPGVMDNPLVMHQLR

SEQ ID NO: 655 - protein, 15 aa, Artificial Sequence
  Description of Artificial Sequence: Synthetic peptide
LEDEEEMNAELTAKK

SEQ ID NO: 656 - protein, 19 aa, Artificial Sequence
  Description of Artificial Sequence: Synthetic peptide
LMATLFSSYATADTGDSGK

SEQ ID NO: 657 - protein, 25 aa, Artificial Sequence
  Description of Artificial Sequence: Synthetic peptide
LQNEIEDLMVDVERSNAAAAALDKK

SEQ ID NO: 658 - protein, 11 aa, Artificial Sequence
  Description of Artificial Sequence: Synthetic peptide
LSYTQQMEDLK

SEQ ID NO: 659 - protein, 20 aa, Artificial Sequence
  Description of Artificial Sequence: Synthetic peptide
MRRDLEEATLQHEATAAALR

SEQ ID NO: 660 - protein, 28 aa, Artificial Sequence
  Description of Artificial Sequence: Synthetic peptide
MVSLLQEKNDLQLQVQAEQDNLADAEER

SEQ ID NO: 661 - protein, 16 aa, Artificial Sequence
  Description of Artificial Sequence: Synthetic peptide
TDAQMADFGAAAQYLR

SEQ ID NO: 662 - protein, 17 aa, Artificial Sequence
  Description of Artificial Sequence: Synthetic peptide
TDAQMADFGAAAQYLRK

SEQ ID NO: 663 - protein, 7 aa, Artificial Sequence
  Description of Artificial Sequence: Synthetic peptide
NMEQTIK

SEQ ID NO: 664 - protein, 12 aa, Artificial Sequence
  Description of Artificial Sequence: Synthetic peptide
NMEQTIKDLQHR

SEQ ID NO: 665 - protein, 30 aa, Artificial Sequence
  Description of Artificial Sequence: Synthetic polypeptide
QREEQAEPDGTEDADKSAYLMGLNSADLLK

SEQ ID NO: 666 - protein, 37 aa, Artificial Sequence
  Description of Artificial Sequence: Synthetic polypeptide
SEAPPHIFSISDNAYQYMLTDRENQSILITGESGAGK

SEQ ID NO: 667 - protein, 18 aa, Artificial Sequence
  Description of Artificial Sequence: Synthetic peptide
TLEDQMNEHRSKAEETQR

SEQ ID NO: 668 - protein, 17 aa, Artificial Sequence
  Description of Artificial Sequence: Synthetic peptide
VKNLTEEMAGLDEIIAK

SEQ ID NO: 669 - protein, 11 aa, Artificial Sequence
  Description of Artificial Sequence: Synthetic peptide
ELTYQTEEDKK

SEQ ID NO: 670 - protein, 11 aa, Artificial Sequence
  Description of Artificial Sequence: Synthetic peptide
ELTYQTEEDKK

SEQ ID NO: 671 - protein, 16 aa, Artificial Sequence
  Description of Artificial Sequence: Synthetic peptide
GQSVQQVYYSIGALAK

SEQ ID NO: 672 - protein, 16 aa, Artificial Sequence
  Description of Artificial Sequence: Synthetic peptide
GQSVQQVYYSIGALAK

SEQ ID NO: 673 - protein, 13 aa, Artificial Sequence
  Description of Artificial Sequence: Synthetic peptide
IKELTYQTEEDKK

SEQ ID NO: 674 - protein, 13 aa, Artificial Sequence
  Description of Artificial Sequence: Synthetic peptide
IKELTYQTEEDKK

SEQ ID NO: 675 - protein, 12 aa, Artificial Sequence
  Description of Artificial Sequence: Synthetic peptide
KDIDDLELTLAK

SEQ ID NO: 676 - protein, 20 aa, Artificial Sequence
  Description of Artificial Sequence: Synthetic peptide
MESDLTQLQSEVEEAVQECR

SEQ ID NO: 677 - protein, 18 aa, Artificial Sequence
  Description of Artificial Sequence: Synthetic peptide
MTDAQMADFGAAAQYLRK

SEQ ID NO: 678 - protein, 14 aa, Artificial Sequence
  Description of Artificial Sequence: Synthetic peptide
SAYLMGLNSADLLK

SEQ ID NO: 679 - protein, 10 aa, Artificial Sequence
  Description of Artificial Sequence: Synthetic peptide
TLEDQANEYR

SEQ ID NO: 680 - protein, 14 aa, Artificial Sequence
  Description of Artificial Sequence: Synthetic peptide
SAYLMGLNSADLLK

SEQ ID NO: 681 - protein, 14 aa, Artificial Sequence
  Description of Artificial Sequence: Synthetic peptide
SAYLMGLNSADLLK

SEQ ID NO: 682 - protein, 11 aa, Artificial Sequence
  Description of Artificial Sequence: Synthetic peptide
DTQIQLDDAVR

SEQ ID NO: 683 - protein, 17 aa, Artificial Sequence
  Description of Artificial Sequence: Synthetic peptide
HADSVAELGEQIDNLQR

SEQ ID NO: 684 - protein, 16 aa, Artificial Sequence
  Description of Artificial Sequence: Synthetic peptide
HRLQNEIEDLMVDVER

SEQ ID NO: 685 - protein, 16 aa, Artificial Sequence
  Description of Artificial Sequence: Synthetic peptide
ILNPAAIPEGQFIDSR

SEQ ID NO: 686 - protein, 21 aa, Artificial Sequence
  Description of Artificial Sequence: Synthetic peptide
KMDADLSQLQTEVEEAVQECR

SEQ ID NO: 687 - protein, 13 aa, Artificial Sequence
  Description of Artificial Sequence: Synthetic peptide
LAEKDEEMEQAKR

SEQ ID NO: 688 - protein, 14 aa, Artificial Sequence
  Description of Artificial Sequence: Synthetic peptide
LQNEIEDLMVDVER

SEQ ID NO: 689 - protein, 10 aa, Artificial Sequence
  Description of Artificial Sequence: Synthetic peptide
LQTENGELSR

SEQ ID NO: 690 - protein, 20 aa, Artificial Sequence
  Description of Artificial Sequence: Synthetic peptide
MDADLSQLQTEVEEAVQECR

SEQ ID NO: 691 - protein, 8 aa, Artificial Sequence
  Description of Artificial Sequence: Synthetic peptide
MFNWMVTR

SEQ ID NO: 692 - protein, 12 aa, Artificial Sequence
  Description of Artificial Sequence: Synthetic peptide
NNLLQAELEELR

SEQ ID NO: 693 - protein, 11 aa, Artificial Sequence
  Description of Artificial Sequence: Synthetic peptide
NALAHALQSAR

SEQ ID NO: 694 - protein, 20 aa, Artificial Sequence
  Description of Artificial Sequence: Synthetic peptide
NDLQLQVQAEQDNLADAEER

SEQ ID NO: 695 - protein, 20 aa, Artificial Sequence
  Description of Artificial Sequence: Synthetic peptide
NDLQLQVQAEQDNLADAEER

SEQ ID NO: 696 - protein, 12 aa, Artificial Sequence
  Description of Artificial Sequence: Synthetic peptide
NNLLQAELEELR

SEQ ID NO: 697 - protein, 12 aa, Artificial Sequence
  Description of Artificial Sequence: Synthetic peptide
NNLLQAELEELR

SEQ ID NO: 698 - protein, 16 aa, Artificial Sequence
  Description of Artificial Sequence: Synthetic peptide
QREEQAEPDGTEEADK

SEQ ID NO: 699 - protein, 13 aa, Artificial Sequence
  Description of Artificial Sequence: Synthetic peptide
RNNLLQAELEELR

SEQ ID NO: 700 - protein, 22 aa, Artificial Sequence
  Description of Artificial Sequence: Synthetic peptide
SEAPPHIFSISDNAYQYMLTDR

SEQ ID NO: 701 - protein, 9 aa, Artificial Sequence
  Description of Artificial Sequence: Synthetic peptide
SVNDLTSQR

SEQ ID NO: 702 - protein, 10 aa, Artificial Sequence
  Description of Artificial Sequence: Synthetic peptide
TLEDQMNEHR

SEQ ID NO: 703 - protein, 14 aa, Artificial Sequence
  Description of Artificial Sequence: Synthetic peptide
VIQYFAVIAAIGDR

SEQ ID NO: 704 - protein, 11 aa, Artificial Sequence
  Description of Artificial Sequence: Synthetic peptide
VQHELDEAEER

SEQ ID NO: 705 - protein, 21 aa, Artificial Sequence
  Description of Artificial Sequence: Synthetic peptide
VQHELDEAEERADIAESQVNK

SEQ ID NO: 706 - protein, 13 aa, Artificial Sequence
  Description of Artificial Sequence: Synthetic peptide
VRELENELEAEQK

SEQ ID NO: 707 - protein, 20 aa, Artificial Sequence
  Description of Artificial Sequence: Synthetic peptide
MDADLSQLQTEVEEAVQECR

SEQ ID NO: 708 - protein, 11 aa, Artificial Sequence
  Description of Artificial Sequence: Synthetic peptide
AGLLGLLEEMR

SEQ ID NO: 709 - protein, 14 aa, Artificial Sequence
  Description of Artificial Sequence: Synthetic peptide
AGLLGLLEEMRDER

SEQ ID NO: 710 - protein, 13 aa, Artificial Sequence
  Description of Artificial Sequence: Synthetic peptide
AVYERMFNWMVTR

SEQ ID NO: 711 - protein, 39 aa, Artificial Sequence
  Description of Artificial Sequence: Synthetic polypeptide
EGIEWTFIDFGMDLQACIDLIEKPMGIMSILEEECMFPK

SEQ ID NO: 712 - protein, 13 aa, Artificial Sequence
  Description of Artificial Sequence: Synthetic peptide
EKEMASMKEEFTR

SEQ ID NO: 713 - protein, 11 aa, Artificial Sequence
  Description of Artificial Sequence: Synthetic peptide
EDQVMQQNPPK

SEQ ID NO: 714 - protein, 11 aa, Artificial Sequence
  Description of Artificial Sequence: Synthetic peptide
EDQVMQQNPPK

SEQ ID NO: 715 - protein, 11 aa, Artificial Sequence
  Description of Artificial Sequence: Synthetic peptide
EDQVMQQNPPK

SEQ ID NO: 716 - protein, 11 aa, Artificial Sequence
  Description of Artificial Sequence: Synthetic peptide
EDQVMQQNPPK

SEQ ID NO: 717 - protein, 11 aa, Artificial Sequence
  Description of Artificial Sequence: Synthetic peptide
EDQVMQQNPPK

SEQ ID NO: 718 - protein, 14 aa, Artificial Sequence
  Description of Artificial Sequence: Synthetic peptide
EDQVMQQNPPKFDK

SEQ ID NO: 719 - protein, 34 aa, Artificial Sequence
  Description of Artificial Sequence: Synthetic polypeptide
EDQVMQQNPPKFDKIEDMAMLTFLHEPAVLYNLK

SEQ ID NO: 720 - protein, 34 aa, Artificial Sequence; identical to SEQ ID NO: 719
  Description of Artificial Sequence: Synthetic polypeptide

SEQ ID NO: 721 - protein, 28 aa, Artificial Sequence
  Description of Artificial Sequence: Synthetic peptide
EEQAEPDGTEEADKSAYLMGLNSADLLK

SEQ ID NO: 722 - protein, 13 aa, Artificial Sequence
  Description of Artificial Sequence: Synthetic peptide
EKEMASMKEEFTR

SEQ ID NO: 723 - protein, 13 aa, Artificial Sequence
  Description of Artificial Sequence: Synthetic peptide
EKEMASMKEEFTR

SEQ ID NO: 724 - protein, 24 aa, Artificial Sequence
  Description of Artificial Sequence: Synthetic peptide
ELEEISERLEEAGGATSVQIEMNK

SEQ ID NO: 725 - protein, 11 aa, Artificial Sequence
  Description of Artificial Sequence: Synthetic peptide
EMASMKEEFTR

SEQ ID NO: 726 - protein, 11 aa, Artificial Sequence
  Description of Artificial Sequence: Synthetic peptide
EMASMKEEFTR

SEQ ID NO: 727 - protein, 19 aa, Artificial Sequence
  Description of Artificial Sequence: Synthetic peptide
EMNERLEDEEEMNAELTAK

SEQ ID NO: 728 - protein, 19 aa, Artificial Sequence
  Description of Artificial Sequence: Synthetic peptide
EMNERLEDEEEMNAELTAK

SEQ ID NO: 729 - protein, 19 aa, Artificial Sequence
  Description of Artificial Sequence: Synthetic peptide
EMNERVEDEEEMNAELTAK

SEQ ID NO: 730 - protein, 11 aa, Artificial Sequence
  Description of Artificial Sequence: Synthetic peptide
EMASMKEEFTR

SEQ ID NO: 731 - protein, 19 aa, Artificial Sequence
  Description of Artificial Sequence: Synthetic peptide
EMNERLEDEEEMNAELTAK

SEQ ID NO: 732 - protein, 23 aa, Artificial Sequence
  Description of Artificial Sequence: Synthetic peptide
FDKIEDMAMLTFLHEPAVLYNLK

SEQ ID NO: 733 - protein, 23 aa, Artificial Sequence
  Description of Artificial Sequence: Synthetic peptide
FDKIEDMAMLTFLHEPAVLYNLK

SEQ ID NO: 734 - protein, 23 aa, Artificial Sequence
  Description of Artificial Sequence: Synthetic peptide
FDKIEDMAMLTFLHEPAVLYNLK

SEQ ID NO: 735 - protein, 16 aa, Artificial Sequence
  Description of Artificial Sequence: Synthetic peptide
GDSEMAVFGAAAPYLR

SEQ ID NO: 736 - protein, 20 aa, Artificial Sequence
  Description of Artificial Sequence: Synthetic peptide
IEDMAMLTFLHEPAVLYNLK

SEQ ID NO: 737 - protein, 20 aa, Artificial Sequence
  Description of Artificial Sequence: Synthetic peptide
IEDMAMLTFLHEPAVLYNLK

SEQ ID NO: 738 - protein, 20 aa, Artificial Sequence
  Description of Artificial Sequence: Synthetic peptide
IEDMAMLTFLHEPAVLYNLK

SEQ ID NO: 739 - protein, 14 aa, Artificial Sequence
  Description of Artificial Sequence: Synthetic peptide
KAITDAAMMAEELK

SEQ ID NO: 740 - protein, 22 aa, Artificial Sequence
  Description of Artificial Sequence: Synthetic peptide
KKMDADLSQLQTEVEEAVQECR

SEQ ID NO: 741 - protein, 19 aa, Artificial Sequence
  Description of Artificial Sequence: Synthetic peptide
KKMEGDLNEMEIQLSHANR

SEQ ID NO: 742 - protein, 19 aa, Artificial Sequence
  Description of Artificial Sequence: Synthetic peptide
KKMEGDLNEMEIQLSHANR

SEQ ID NO: 743 - protein, 13 aa, Artificial Sequence
  Description of Artificial Sequence: Synthetic peptide
KLAEKDEEMEQAK

SEQ ID NO: 744 - protein, 21 aa, Artificial Sequence
  Description of Artificial Sequence: Synthetic peptide
KMDADLSQLQTEVEEAVQECR

SEQ ID NO: 745 - protein, 18 aa, Artificial Sequence
  Description of Artificial Sequence: Synthetic peptide
KMEGDLNEMEIQLSHANR

SEQ ID NO: 746 - protein, 18 aa, Artificial Sequence
  Description of Artificial Sequence: Synthetic peptide
KMEGDLNEMEIQLSHANR

SEQ ID NO: 747 - protein, 18 aa, Artificial Sequence
  Description of Artificial Sequence: Synthetic peptide
KMEGDLNEMEIQLSHANR

SEQ ID NO: 748 - protein, 27 aa, Artificial Sequence
  Description of Artificial Sequence: Synthetic peptide
KQLEAEKMELQSALEEAEASLEHEEGK

SEQ ID NO: 749 - protein, 12 aa, Artificial Sequence
  Description of Artificial Sequence: Synthetic peptide
LAEKDEEMEQAK

SEQ ID NO: 750 - protein, 13 aa, Artificial Sequence
  Description of Artificial Sequence: Synthetic peptide
LAEKDEEMEQAKR

SEQ ID NO: 751 - protein, 14 aa, Artificial Sequence
  Description of Artificial Sequence: Synthetic peptide
LEDEEEMNAELTAK

SEQ ID NO: 752 - protein, 14 aa, Artificial Sequence
  Description of Artificial Sequence: Synthetic peptide
LEDEEEMNAELTAK

SEQ ID NO: 753 - protein, 16 aa, Artificial Sequence
  Description of Artificial Sequence: Synthetic peptide
LEEAGGATSVQIEMNK

SEQ ID NO: 754 - protein, 16 aa, Artificial Sequence
  Description of Artificial Sequence: Synthetic peptide
LEEAGGATSVQIEMNK

SEQ ID NO: 755 - protein, 17 aa, Artificial Sequence
  Description of Artificial Sequence: Synthetic peptide
LEEAGGATSVQIEMNKK

SEQ ID NO: 756 - protein, 15 aa, Artificial Sequence
  Description of Artificial Sequence: Synthetic peptide
LELDDVTSNMEQIIK

SEQ ID NO: 757 - protein, 15 aa, Artificial Sequence
  Description of Artificial Sequence: Synthetic peptide
LELDDVTSNMEQIIK

SEQ ID NO: 758 - protein, 14 aa, Artificial Sequence
  Description of Artificial Sequence: Synthetic peptide
LQNEIEDLMVDVER

SEQ ID NO: 759 - protein, 14 aa, Artificial Sequence
  Description of Artificial Sequence: Synthetic peptide
LQNEIEDLMVDVER

SEQ ID NO: 760 - protein, 18 aa, Artificial Sequence
  Description of Artificial Sequence: Synthetic peptide
LQQFFNHHMFVLEQEEYK

SEQ ID NO: 761 - protein, 19 aa, Artificial Sequence
  Description of Artificial Sequence: Synthetic peptide
LQQFFNHHMFVLEQEEYKK

SEQ ID NO: 762 - protein, 12 aa, Artificial Sequence
  Description of Artificial Sequence: Synthetic peptide
LTGAIMHFGNMK

SEQ ID NO: 763 - protein, 12 aa, Artificial Sequence
  Description of Artificial Sequence: Synthetic peptide
LTGAIMHFGNMK

SEQ ID NO: 764 - protein, 12 aa, Artificial Sequence
  Description of Artificial Sequence: Synthetic peptide
LTGAIMHFGNMK

SEQ ID NO: 765 - protein, 13 aa, Artificial Sequence
  Description of Artificial Sequence: Synthetic peptide
LTQESIMDLENDK

SEQ ID NO: 766 - protein, 13 aa, Artificial Sequence
  Description of Artificial Sequence: Synthetic peptide
LTQESIMDLENDK

SEQ ID NO: 767 - protein, 19 aa, Artificial Sequence
  Description of Artificial Sequence: Synthetic peptide
LTQESIMDLENDKQQLDER

SEQ ID NO: 768 - protein, 10 aa, Artificial Sequence
  Description of Artificial Sequence: Synthetic peptide
MAAEAQKQVK

SEQ ID NO: 769 - protein, 20 aa, Artificial Sequence
  Description of Artificial Sequence: Synthetic peptide
MDADLSQLQTEVEEAVQECR

SEQ ID NO: 770 - protein, 17 aa, Artificial Sequence
  Description of Artificial Sequence: Synthetic peptide
MEGDLNEMEIQLSHANR

SEQ ID NO: 771 - protein, 17 aa, Artificial Sequence
  Description of Artificial Sequence: Synthetic peptide
MEGDLNEMEIQLSHANR

SEQ ID NO: 772 - protein, 20 aa, Artificial Sequence
  Description of Artificial Sequence: Synthetic peptide
MELQSALEEAEASLEHEEGK

SEQ ID NO: 773 - protein, 20 aa, Artificial Sequence
  Description of Artificial Sequence: Synthetic peptide
MELQSALEEAEASLEHEEGK

SEQ ID NO: 774 - protein, 8 aa, Artificial Sequence
  Description of Artificial Sequence: Synthetic peptide
MFNWMVTR

SEQ ID NO: 775 - protein, 8 aa, Artificial Sequence
  Description of Artificial Sequence: Synthetic peptide
MFNWMVTR

SEQ ID NO: 776 - protein, 8 aa, Artificial Sequence
  Description of Artificial Sequence: Synthetic peptide
MVSLLQEK

SEQ ID NO: 777 - protein, 8 aa, Artificial Sequence
  Description of Artificial Sequence: Synthetic peptide
MVSLLQEK

SEQ ID NO: 778 - protein, 17 aa, Artificial Sequence
  Description of Artificial Sequence: Synthetic peptide
MEGDLNEMEIQLSHANR

SEQ ID NO: 779 - protein, 8 aa, Artificial Sequence
  Description of Artificial Sequence: Synthetic peptide
MFNWMVTR

SEQ ID NO: 780 - protein, 15 aa, Artificial Sequence
  Description of Artificial Sequence: Synthetic peptide
NLTEEMAGLDEIIAK

SEQ ID NO: 781 - protein, 16 aa, Artificial Sequence
  Description of Artificial Sequence: Synthetic peptide
GDSEMAVFGAAAPYLR

SEQ ID NO: 782 - protein, 17 aa, Artificial Sequence
  Description of Artificial Sequence: Synthetic peptide
GDSEMAVFGAAAPYLRK

SEQ ID NO: 783 - protein, 9 aa, Artificial Sequence
  Description of Artificial Sequence: Synthetic peptide
NAESVKGMR

SEQ ID NO: 784 - protein, 15 aa, Artificial Sequence
  Description of Artificial Sequence: Synthetic peptide
NLTEEMAGLDEIIAK

SEQ ID NO: 785 - protein, 17 aa, Artificial Sequence
  Description of Artificial Sequence: Synthetic peptide
NSMYKLTGAIMHFGNMK

SEQ ID NO: 786 - protein, 26 aa, Artificial Sequence
  Description of Artificial Sequence: Synthetic peptide
QLEAEKMELQSALEEAEASLEHEEGK

SEQ ID NO: 787 - protein, 30 aa, Artificial Sequence
  Description of Artificial Sequence: Synthetic polypeptide
QREEQAEPDGTEEADKSAYLMGLNSADLLK

SEQ ID NO: 788 - protein, 26 aa, Artificial Sequence
  Description of Artificial Sequence: Synthetic peptide
QLEAEKMELQSALEEAEASLEHEEGK

SEQ ID NO: 789 - protein, 30 aa, Artificial Sequence; identical to SEQ ID NO: 787
  Description of Artificial Sequence: Synthetic polypeptide

SEQ ID NO: 790 - protein, 23 aa, Artificial Sequence
  Description of Artificial Sequence: Synthetic peptide
RSEAPPHIFSISDNAYQYMLTDR

SEQ ID NO: 791 - protein, 12 aa, Artificial Sequence
  Description of Artificial Sequence: Synthetic peptide
SAETEKEMATMK

SEQ ID NO: 792 - protein, 14 aa, Artificial Sequence
  Description of Artificial Sequence: Synthetic peptide
SAYLMGLNSADLLK

SEQ ID NO: 793 - protein, 14 aa, Artificial Sequence
  Description of Artificial Sequence: Synthetic peptide
SAYLMGLNSADLLK

SEQ ID NO: 794 - protein, 22 aa, Artificial Sequence
  Description of Artificial Sequence: Synthetic peptide
SEAPPHIFSISDNAYQYMLTDR

SEQ ID NO: 795 - protein, 22 aa, Artificial Sequence
  Description of Artificial Sequence: Synthetic peptide
SEAPPHIFSISDNAYQYMLTDR

SEQ ID NO: 796 - protein, 19 aa, Artificial Sequence
  Description of Artificial Sequence: Synthetic peptide
SEFKLELDDVTSNMEQIIK

SEQ ID NO: 797 - protein, 15 aa, Artificial Sequence
  Description of Artificial Sequence: Synthetic peptide
SPGVMDNPLVMHQLR

SEQ ID NO: 798 - protein, 15 aa, Artificial Sequence
  Description of Artificial Sequence: Synthetic peptide
SPGVMDNPLVMHQLR

SEQ ID NO: 799 - protein, 15 aa, Artificial Sequence
  Description of Artificial Sequence: Synthetic peptide
SPGVMDNPLVMHQLR

SEQ ID NO: 800 - protein, 10 aa, Artificial Sequence
  Description of Artificial Sequence: Synthetic peptide
TLEDQMNEHR

SEQ ID NO: 801 - protein, 12 aa, Artificial Sequence
  Description of Artificial Sequence: Synthetic peptide
TLEDQMNEHRSK

SEQ ID NO: 802 - protein, 16 aa, Artificial Sequence
  Description of Artificial Sequence: Synthetic peptide
TVTVKEDQVMQQNPPK

SEQ ID NO: 803 - protein, 19 aa, Artificial Sequence
  Description of Artificial Sequence: Synthetic peptide
TVTVKEDQVMQQNPPKFDK

SEQ ID NO: 804 - protein, 18 aa, Artificial Sequence
  Description of Artificial Sequence: Synthetic peptide
VFFKAGLLGLLEEMRDER

SEQ ID NO: 805 - protein, 21 aa, Artificial Sequence
  Description of Artificial Sequence: Synthetic peptide
VKEMNERLEDEEEMNAELTAK

SEQ ID NO: 806 - protein, 21 aa, Artificial Sequence
  Description of Artificial Sequence: Synthetic peptide
VKEMNERLEDEEEMNAELTAK

SEQ ID NO: 807 - protein, 21 aa, Artificial Sequence
  Description of Artificial Sequence: Synthetic peptide
VKEMNERLEDEEEMNAELTAK

SEQ ID NO: 808 - protein, 7 aa, Artificial Sequence
  Description of Artificial Sequence: Synthetic peptide
VRMDLER

SEQ ID NO: 809 - protein, 11 aa, Artificial Sequence
  Description of Artificial Sequence: Synthetic peptide
ELTYQTEEDRK

SEQ ID NO: 810 - protein, 11 aa, Artificial Sequence
  Description of Artificial Sequence: Synthetic peptide
ELTYQTEEDRK

SEQ ID NO: 811 - protein, 10 aa, Artificial Sequence
  Description of Artificial Sequence: Synthetic peptide
ELTYQTEEDR

SEQ ID NO: 812 - protein, 11 aa, Artificial Sequence
  Description of Artificial Sequence: Synthetic peptide
ELTYQTEEDRK

SEQ ID NO: 813 - protein, 11 aa, Artificial Sequence
  Description of Artificial Sequence: Synthetic peptide
ELTYQTEEDRK

SEQ ID NO: 814 - protein, 15 aa, Artificial Sequence
  Description of Artificial Sequence: Synthetic peptide
ENQSILITGESGAGK

SEQ ID NO: 815 - protein, 10 aa, Artificial Sequence
  Description of Artificial Sequence: Synthetic peptide
EQYEEETEAK

SEQ ID NO: 816 - protein, 16 aa, Artificial Sequence
  Description of Artificial Sequence: Synthetic peptide
GDSEMAVFGAAAPYLR

SEQ ID NO: 817 - protein, 13 aa, Artificial Sequence
  Description of Artificial Sequence: Synthetic peptide
GKLTYTQQLEDLK

SEQ ID NO: 818 - protein, 13 aa, Artificial Sequence
  Description of Artificial Sequence: Synthetic peptide
GKLTYTQQLEDLK

SEQ ID NO: 819 - protein, 14 aa, Artificial Sequence
  Description of Artificial Sequence: Synthetic peptide
GKLTYTQQLEDLKR

SEQ ID NO: 820 - protein, 13 aa, Artificial Sequence
  Description of Artificial Sequence: Synthetic peptide
GKLTYTQQLEDLK

SEQ ID NO: 821 - protein, 14 aa, Artificial Sequence
  Description of Artificial Sequence: Synthetic peptide
GKLTYTQQLEDLKR

SEQ ID NO: 822 - protein, 21 aa, Artificial Sequence
  Description of Artificial Sequence: Synthetic peptide
GTLEDQIIQANPALEAFGNAK

SEQ ID NO: 823 - protein, 17 aa, Artificial Sequence
  Description of Artificial Sequence: Synthetic peptide
HADSVAELGEQIDNLQR

SEQ ID NO: 824 - protein, 13 aa, Artificial Sequence
  Description of Artificial Sequence: Synthetic peptide
IKELTYQTEEDRK

SEQ ID NO: 825 - protein, 12 aa, Artificial Sequence
  Description of Artificial Sequence: Synthetic peptide
IKELTYQTEEDR

SEQ ID NO: 826 - protein, 13 aa, Artificial Sequence
  Description of Artificial Sequence: Synthetic peptide
IKELTYQTEEDRK

SEQ ID NO: 827 - protein, 13 aa, Artificial Sequence
  Description of Artificial Sequence: Synthetic peptide
IKELTYQTEEDRK

SEQ ID NO: 828 - protein, 16 aa, Artificial Sequence
  Description of Artificial Sequence: Synthetic peptide
LKNAYEESLEHLETFK

SEQ ID NO: 829 - protein, 17 aa, Artificial Sequence
  Description of Artificial Sequence: Synthetic peptide
LKNAYEESLEHLETFKR

SEQ ID NO: 830 - protein, 17 aa, Artificial Sequence
  Description of Artificial Sequence: Synthetic peptide
LKNAYEESLEHLETFKR

SEQ ID NO: 831 - protein, 13 aa, Artificial Sequence
  Description of Artificial Sequence: Synthetic peptide
LLSSLDIDHNQYK

SEQ ID NO: 832 - protein, 11 aa, Artificial Sequence
  Description of Artificial Sequence: Synthetic peptide
LTYTQQLEDLK

SEQ ID NO: 833 - protein, 12 aa, Artificial Sequence
  Description of Artificial Sequence: Synthetic peptide
LTYTQQLEDLKR

SEQ ID NO: 834 - protein, 11 aa, Artificial Sequence
  Description of Artificial Sequence: Synthetic peptide
LTYTQQLEDLK

SEQ ID NO: 835 - protein, 12 aa, Artificial Sequence
  Description of Artificial Sequence: Synthetic peptide
LTYTQQLEDLKR

SEQ ID NO: 836 - protein, 12 aa, Artificial Sequence
  Description of Artificial Sequence: Synthetic peptide
LTYTQQLEDLKR

SEQ ID NO: 837 - protein, 8 aa, Artificial Sequence
  Description of Artificial Sequence: Synthetic peptide
LYDNHLGK

SEQ ID NO: 838 - protein, 14 aa, Artificial Sequence
  Description of Artificial Sequence: Synthetic peptide
NAYEESLEHLETFK

SEQ ID NO: 839 - protein, 15 aa, Artificial Sequence
  Description of Artificial Sequence: Synthetic peptide
NAYEESLEHLETFKR

SEQ ID NO: 840 - protein, 15 aa, Artificial Sequence
  Description of Artificial Sequence: Synthetic peptide
NKDPLNETVVALYQK

SEQ ID NO: 841 - protein, 15 aa, Artificial Sequence
  Description of Artificial Sequence: Synthetic peptide
QKYEESQSELESSQK

SEQ ID NO: 842 - protein, 15 aa, Artificial Sequence
  Description of Artificial Sequence: Synthetic peptide
QKYEESQSELESSQK

SEQ ID NO: 843 - protein, 15 aa, Artificial Sequence
  Description of Artificial Sequence: Synthetic peptide
QKYEESQSELESSQK

SEQ ID NO: 844 - protein, 13 aa, Artificial Sequence
  Description of Artificial Sequence: Synthetic peptide
RIKELTYQTEEDR

SEQ ID NO: 845 - protein, 14 aa, Artificial Sequence
  Description of Artificial Sequence: Synthetic peptide
SAYLMGLNSADLLK

SEQ ID NO: 846 - protein, 10 aa, Artificial Sequence
  Description of Artificial Sequence: Synthetic peptide
TKYETDAIQR

SEQ ID NO: 847 - protein, 10 aa, Artificial Sequence
  Description of Artificial Sequence: Synthetic peptide
TKYETDAIQR

SEQ ID NO: 848 - protein, 10 aa, Artificial Sequence
  Description of Artificial Sequence: Synthetic peptide
TKYETDAIQR

SEQ ID NO: 849 - protein, 20 aa, Artificial Sequence
  Description of Artificial Sequence: Synthetic peptide
IEDMAMLTFLHEPAVLYNLK

SEQ ID NO: 850 - protein, 23 aa, Artificial Sequence
  Description of Artificial Sequence: Synthetic peptide
RSEAPPHIFSISDNAYQYMLTDR

SEQ ID NO: 851 - protein, 22 aa, Artificial Sequence
  Description of Artificial Sequence: Synthetic peptide
SEAPPHIFSISDNAYQYMLTDR

SEQ ID NO: 852 - protein, 8 aa, Artificial Sequence
  Description of Artificial Sequence: Synthetic peptide
KMVLYTLR

SEQ ID NO: 853 - protein, 7 aa, Artificial Sequence
  Description of Artificial Sequence: Synthetic peptide
MVLYTLR

SEQ ID NO: 854 - protein, 10 aa, Artificial Sequence
  Description of Artificial Sequence: Synthetic peptide
MVQGSGCFGR

SEQ ID NO: 855 - protein, 21 aa, Artificial Sequence
  Description of Artificial Sequence: Synthetic peptide
CSVIRDSLLQDGEFSMDLRTK

SEQ ID NO: 856 - protein, 21 aa, Artificial Sequence
  Description of Artificial Sequence: Synthetic peptide
CSVIRDSLLQDGEFSMDLRTK

SEQ ID NO: 857 - protein, 19 aa, Artificial Sequence
  Description of Artificial Sequence: Synthetic peptide
CSVIRDSLLQDGEFSMDLR

SEQ ID NO: 858 - protein, 21 aa, Artificial Sequence
  Description of Artificial Sequence: Synthetic peptide
CSVIRDSLLQDGEFSMDLRTK

SEQ ID NO: 859 - protein, 21 aa, Artificial Sequence
  Description of Artificial Sequence: Synthetic peptide
CSVIRDSLLQDGEFSMDLRTK

SEQ ID NO: 860 - protein, 21 aa, Artificial Sequence
  Description of Artificial Sequence: Synthetic peptide
CSVIRDSLLQDGEFSMDLRTK

SEQ ID NO: 861 - protein, 16 aa, Artificial Sequence
  Description of Artificial Sequence: Synthetic peptide
DRSSFYVNGLTLGGQK

SEQ ID NO: 862 - protein, 16 aa, Artificial Sequence
  Description of Artificial Sequence: Synthetic peptide
DRSSFYVNGLTLGGQK

SEQ ID NO: 863 - protein, 14 aa, Artificial Sequence
  Description of Artificial Sequence: Synthetic peptide
DSLLQDGEFSMDLR

SEQ ID NO: 864 - protein, 18 aa, Artificial Sequence
  Description of Artificial Sequence: Synthetic peptide
TFVNITPAEVGVLVGKDR

SEQ ID NO: 865 - protein, 18 aa, Artificial Sequence
  Description of Artificial Sequence: Synthetic peptide
TFVNITPAEVGVLVGKDR

SEQ ID NO: 866 - protein, 21 aa, Artificial Sequence
  Description of Artificial Sequence: Synthetic peptide
CSVIRDSLLQDGEFSMDLRTK

SEQ ID NO: 867 - protein, 21 aa, Artificial Sequence
  Description of Artificial Sequence: Synthetic peptide
CSVIRDSLLQDGEFSMDLRTK

SEQ ID NO: 868 - protein, 14 aa, Artificial Sequence
  Description of Artificial Sequence: Synthetic peptide
DSLLQDGEFSMDLR

SEQ ID NO: 869 - protein, 14 aa, Artificial Sequence
  Description of Artificial Sequence: Synthetic peptide
DSLLQDGEFSMDLR

SEQ ID NO: 870 - protein, 21 aa, Artificial Sequence
  Description of Artificial Sequence: Synthetic peptide
CSVIRDSLLQDGEFSMDLRTK

SEQ ID NO: 871 - protein, 21 aa, Artificial Sequence
  Description of Artificial Sequence: Synthetic peptide
CSVIRDSLLQDGEFSMDLRTK

SEQ ID NO: 872 - protein, 9 aa, Artificial Sequence
  Description of Artificial Sequence: Synthetic peptide
CYEMASHLR

SEQ ID NO: 873 - protein, 9 aa, Artificial Sequence
  Description of Artificial Sequence: Synthetic peptide
CYEMASHLR

SEQ ID NO: 874 - protein, 9 aa, Artificial Sequence
  Description of Artificial Sequence: Synthetic peptide
CYEMASHLR

SEQ ID NO: 875 - protein, 9 aa, Artificial Sequence
  Description of Artificial Sequence: Synthetic peptide
CYEMASHLR

SEQ ID NO: 876 - protein, 9 aa, Artificial Sequence
  Description of Artificial Sequence: Synthetic peptide
CYEMASHLR

SEQ ID NO: 877 - protein, 10 aa, Artificial Sequence
  Description of Artificial Sequence: Synthetic peptide
CYEMASHLRR

SEQ ID NO: 878 - protein, 9 aa, Artificial Sequence
  Description of Artificial Sequence: Synthetic peptide
CYEMASHLR

SEQ ID NO: 879 - protein, 21 aa, Artificial Sequence
  Description of Artificial Sequence: Synthetic peptide
CSVIRDSLLQDGEFSMDLRTK

SEQ ID NO: 880 - protein, 19 aa, Artificial Sequence
  Description of Artificial Sequence: Synthetic peptide
CSVIRDSLLQDGEFSMDLR

SEQ ID NO: 881 - protein, 21 aa, Artificial Sequence
  Description of Artificial Sequence: Synthetic peptide
CSVIRDSLLQDGEFSMDLRTK

SEQ ID NO: 882 - protein, 9 aa, Artificial Sequence
  Description of Artificial Sequence: Synthetic peptide
CYEMASHLR

SEQ ID NO: 883 - protein, 9 aa, Artificial Sequence
  Description of Artificial Sequence: Synthetic peptide
CYEMASHLR

SEQ ID NO: 884 - protein, 10 aa, Artificial Sequence
  Description of Artificial Sequence: Synthetic peptide
CYEMASHLRR

SEQ ID NO: 885 - protein, 14 aa, Artificial Sequence
  Description of Artificial Sequence: Synthetic peptide
DSLLQDGEFSMDLR

SEQ ID NO: 886 - protein, 14 aa, Artificial Sequence
  Description of Artificial Sequence: Synthetic peptide
DSLLQDGEFSMDLR

SEQ ID NO: 887 - protein, 10 aa, Artificial Sequence
  Description of Artificial Sequence: Synthetic peptide
KCYEMASHLR

SEQ ID NO: 888 - protein, 26 aa, Artificial Sequence
  Description of Artificial Sequence: Synthetic peptide
MAGWNAYIDNLMADGTCQDAAIVGYK

SEQ ID NO: 889 - protein, 25 aa, Artificial Sequence
  Description of Artificial Sequence: Synthetic peptide
AGWNAYIDNLMADGTCQDAAIVGYK

SEQ ID NO: 890 - protein, 25 aa, Artificial Sequence
  Description of Artificial Sequence: Synthetic peptide
AGWNAYIDNLMADGTCQDAAIVGYK

SEQ ID NO: 891 - protein, 26 aa, Artificial Sequence
  Description of Artificial Sequence: Synthetic peptide
MAGWNAYIDNLMADGTCQDAAIVGYK

SEQ ID NO: 892 - protein, 11 aa, Artificial Sequence
  Description of Artificial Sequence: Synthetic peptide
TDKTLVLLMGK

SEQ ID NO: 893 - protein, 21 aa, Artificial Sequence
  Description of Artificial Sequence: Synthetic peptide
TDKTLVLLMGKEGVHGGLINK

SEQ ID NO: 894 - protein, 8 aa, Artificial Sequence
  Description of Artificial Sequence: Synthetic peptide
TLVLLMGK

SEQ ID NO: 895 - protein, 18 aa, Artificial Sequence
  Description of Artificial Sequence: Synthetic peptide
TLVLLMGKEGVHGGLINK

SEQ ID NO: 896 - protein, 25 aa, Artificial Sequence
  Description of Artificial Sequence: Synthetic peptide
AGWNAYIDNLMADGTCQDAAIVGYK

SEQ ID NO: 897 - protein, 25 aa, Artificial Sequence
  Description of Artificial Sequence: Synthetic peptide
AGWNAYIDNLMADGTCQDAAIVGYK

SEQ ID NO: 898 - protein, 37 aa, Artificial Sequence
  Description of Artificial Sequence: Synthetic polypeptide
AGWNAYIDNLMADGTCQDAAIVGYKDSPSVWAAVPGK

SEQ ID NO: 899 - protein, 25 aa, Artificial Sequence
  Description of Artificial Sequence: Synthetic peptide
AGWNAYIDNLMADGTCQDAAIVGYK

SEQ ID NO: 900 - protein, 24 aa, Artificial Sequence
  Description of Artificial Sequence: Synthetic peptide
GWNAYIDNLMADGTCQDAAIVGYK

SEQ ID NO: 901 - protein, 26 aa, Artificial Sequence
  Description of Artificial Sequence: Synthetic peptide
MAGWNAYIDNLMADGTCQDAAIVGYK

SEQ ID NO: 902 - protein, 25 aa, Artificial Sequence
  Description of Artificial Sequence: Synthetic peptide
AGWNAYIDNLMADGTCQDAAIVGYK

SEQ ID NO: 903 - protein, 25 aa, Artificial Sequence
  Description of Artificial Sequence: Synthetic peptide
AGWNAYIDNLMADGTCQDAAIVGYK

SEQ ID NO: 904 - protein, 37 aa, Artificial Sequence; identical to SEQ ID NO: 898
  Description of Artificial Sequence: Synthetic polypeptide

SEQ ID NO: 905 - protein, 9 aa, Artificial Sequence
  Description of Artificial Sequence: Synthetic peptide
CYEMASHLR

SEQ ID NO: 906 - protein, 11 aa, Artificial Sequence
  Description of Artificial Sequence: Synthetic peptide
DSLLQDGEFSM

SEQ ID NO: 907 - protein, 25 aa, Artificial Sequence
  Description of Artificial Sequence: Synthetic peptide
AGWNAYIDNLMADGTCQDAAIVGYK

SEQ ID NO: 908 - protein, 26 aa, Artificial Sequence
  Description of Artificial Sequence: Synthetic peptide
MAGWNAYIDNLMADGTCQDAAIVGYK

SEQ ID NO: 909 - protein, 21 aa, Artificial Sequence
  Description of Artificial Sequence: Synthetic peptide
TDKTLVLLMGKEGVHGGLINK

SEQ ID NO: 910 - protein, 18 aa, Artificial Sequence
  Description of Artificial Sequence: Synthetic peptide
EGGLGPLNIPLLADVTRR

SEQ ID NO: 911 - protein, 18 aa, Artificial Sequence
  Description of Artificial Sequence: Synthetic peptide
EGGLGPLNIPLLADVTRR

SEQ ID NO: 912 - protein, 27 aa, Artificial Sequence
  Description of Artificial Sequence: Synthetic peptide
GKYVVLFFYPLDFTFVCPTEIIAFSNR

SEQ ID NO: 913 - protein, 18 aa, Artificial Sequence
  Description of Artificial Sequence: Synthetic peptide
KEGGLGPLNIPLLADVTR

SEQ ID NO: 914 - protein, 19 aa, Artificial Sequence
  Description of Artificial Sequence: Synthetic peptide
KEGGLGPLNIPLLADVTRR

SEQ ID NO: 915 - protein, 19 aa, Artificial Sequence
  Description of Artificial Sequence: Synthetic peptide
KEGGLGPLNIPLLADVTRR

SEQ ID NO: 916 - protein, 25 aa, Artificial Sequence
  Description of Artificial Sequence: Synthetic peptide
KLGCEVLGVSVDSQFTHLAWINTPR

SEQ ID NO: 917 - protein, 24 aa, Artificial Sequence
  Description of Artificial Sequence: Synthetic peptide
LGCEVLGVSVDSQFTHLAWINTPR

SEQ ID NO: 918 - protein, 25 aa, Artificial Sequence
  Description of Artificial Sequence: Synthetic peptide
LGCEVLGVSVDSQFTHLAWINTPRK

SEQ ID NO: 919 - protein, 11 aa, Artificial Sequence
  Description of Artificial Sequence: Synthetic peptide
QITVNDLPVGR

SEQ ID NO: 920 - protein, 18 aa, Artificial Sequence
  Description of Artificial Sequence: Synthetic peptide
RLSEDYGVLKTDEGIAYR

SEQ ID NO: 921 - protein, 18 aa, Artificial Sequence
  Description of Artificial Sequence: Synthetic peptide
RLSEDYGVLKTDEGIAYR

SEQ ID NO: 922 - protein, 18 aa, Artificial Sequence
  Description of Artificial Sequence: Synthetic peptide
RLSEDYGVLKTDEGIAYR

SEQ ID NO: 923 - protein, 7 aa, Artificial Sequence
  Description of Artificial Sequence: Synthetic peptide
SVDEALR

SEQ ID NO: 924 - protein, 8 aa, Artificial Sequence
  Description of Artificial Sequence: Synthetic peptide
IMETLPPK

SEQ ID NO: 925 - protein, 18 aa, Artificial Sequence
  Description of Artificial Sequence: Synthetic peptide
LEEHLEGIVNIFHQYSVR

SEQ ID NO: 926 - protein, 21 aa, Artificial Sequence
  Description of Artificial Sequence: Synthetic peptide
TKLEEHLEGIVNIFHQYSVRK

SEQ ID NO: 927 - protein, 20 aa, Artificial Sequence
  Description of Artificial Sequence: Synthetic peptide
TKLEEHLEGIVNIFHQYSVR

SEQ ID NO: 928 - protein, 21 aa, Artificial Sequence
  Description of Artificial Sequence: Synthetic peptide
TKLEEHLEGIVNIFHQYSVRK

SEQ ID NO: 929 - protein, 13 aa, Artificial Sequence
  Description of Artificial Sequence: Synthetic peptide
ELLTRELPSFLGK

SEQ ID NO: 930 - protein, 9 aa, Artificial Sequence
  Description of Artificial Sequence: Synthetic peptide
RTDEAAFQK

SEQ ID NO: 931 - protein, 11 aa, Artificial Sequence
  Description of Artificial Sequence: Synthetic peptide
ALDVMVSTFHK

SEQ ID NO: 932 - protein, 9 aa, Artificial Sequence
  Description of Artificial Sequence: Synthetic peptide
LMSNLDSNR

SEQ ID NO: 933 - protein, 42 aa, Artificial Sequence
  Description of Artificial Sequence: Synthetic polypeptide
LMSNLDSNRDNEVDFQEYCVFLSCIAMMCNEFFEGFPDKQPR

SEQ ID NO: 934 - protein, 42 aa, Artificial Sequence; identical to SEQ ID NO: 933
  Description of Artificial Sequence: Synthetic polypeptide

SEQ ID NO: 935 - protein, 30 aa, Artificial Sequence
  Description of Artificial Sequence: Synthetic polypeptide
DNEVDFQEYCVFLSCIAMMCNEFFEGFPDK

SEQ ID NO: 936 - protein, 8 aa, Artificial Sequence
  Description of Artificial Sequence: Synthetic peptide
LQDAEIAR

SEQ ID NO: 937 - protein, 17 aa, Artificial Sequence
  Description of Artificial Sequence: Synthetic peptide
LQDAEIARLMEDLDRNK

SEQ ID NO: 938 - protein, 7 aa, Artificial Sequence
  Description of Artificial Sequence: Synthetic peptide
LMEDLDR

SEQ ID NO: 939 - protein, 17 aa, Artificial Sequence
  Description of Artificial Sequence: Synthetic peptide
LQDAEIARLMEDLDRNK

SEQ ID NO: 940 - protein, 17 aa, Artificial Sequence
  Description of Artificial Sequence: Synthetic peptide
LQDAEIARLMEDLDRNK

SEQ ID NO: 941 - protein, 18 aa, Artificial Sequence
  Description of Artificial Sequence: Synthetic peptide
MACPLDQAIGLLVAIFHK

SEQ ID NO: 942 - protein, 18 aa, Artificial Sequence
  Description of Artificial Sequence: Synthetic peptide
MACPLDQAIGLLVAIFHK

SEQ ID NO: 943 - protein, 18 aa, Artificial Sequence
  Description of Artificial Sequence: Synthetic peptide
MACPLDQAIGLLVAIFHK

SEQ ID NO: 944 - protein, 11 aa, Artificial Sequence
  Description of Artificial Sequence: Synthetic peptide
IEKPSLLTMMK

SEQ ID NO: 945 - protein, 11 aa, Artificial Sequence
  Description of Artificial Sequence: Synthetic peptide
SIIGMIDMFHK

SEQ ID NO: 946 - protein, 21 aa, Artificial Sequence
  Description of Artificial Sequence: Synthetic peptide
MSQLERNIETIINTFHQYSVK

SEQ ID NO: 947 - protein, 21 aa, Artificial Sequence
  Description of Artificial Sequence: Synthetic peptide
MSQLERNIETIINTFHQYSVK

SEQ ID NO: 948 - protein, 21 aa, Artificial Sequence
  Description of Artificial Sequence: Synthetic peptide
MSQLERNIETIINTFHQYSVK

SEQ ID NO: 949 - protein, 21 aa, Artificial Sequence
  Description of Artificial Sequence: Synthetic peptide
MSQLERNIETIINTFHQYSVK

SEQ ID NO: 950 - protein, 13 aa, Artificial Sequence
  Description of Artificial Sequence: Synthetic peptide
QLSFEEFIMLMAR

SEQ ID NO: 951 - protein, 13 aa, Artificial Sequence
  Description of Artificial Sequence: Synthetic peptide
QLSFEEFIMLMAR

SEQ ID NO: 952 - protein, 21 aa, Artificial Sequence
  Description of Artificial Sequence: Synthetic peptide
QLSFEEFIMLMARLTWASHEK

SEQ ID NO: 953 - protein, 21 aa, Artificial Sequence
  Description of Artificial Sequence: Synthetic peptide
MSQLERNIETIINTFHQYSVK

SEQ ID NO: 954 - protein, 21 aa, Artificial Sequence
  Description of Artificial Sequence: Synthetic peptide
MSQLERNIETIINTFHQYSVK

SEQ ID NO: 955 - protein, 21 aa, Artificial Sequence
  Description of Artificial Sequence: Synthetic peptide
MSQLERNIETIINTFHQYSVK

SEQ ID NO: 956 - protein, 21 aa, Artificial Sequence
  Description of Artificial Sequence: Synthetic peptide
MSQLERNIETIINTFHQYSVK

SEQ ID NO: 957 - protein, 21 aa, Artificial Sequence
  Description of Artificial Sequence: Synthetic peptide
MSQLERNIETIINTFHQYSVK

SEQ ID NO: 958 - protein, 21 aa, Artificial Sequence
  Description of Artificial Sequence: Synthetic peptide
MSQLERNIETIINTFHQYSVK

SEQ ID NO: 959 - protein, 13 aa, Artificial Sequence
  Description of Artificial Sequence: Synthetic peptide
MHEGDEGPGHHHK

SEQ ID NO: 960 - protein, 21 aa, Artificial Sequence
  Description of Artificial Sequence: Synthetic peptide
MHEGDEGPGHHHKPGLGEGTP

SEQ ID NO: 961 - protein, 21 aa, Artificial Sequence
  Description of Artificial Sequence: Synthetic peptide
MSQLERNIETIINTFHQYSVK

SEQ ID NO: 962 - protein, 21 aa, Artificial Sequence
  Description of Artificial Sequence: Synthetic peptide
MSQLERNIETIINTFHQYSVK

SEQ ID NO: 963 - protein, 21 aa, Artificial Sequence
  Description of Artificial Sequence: Synthetic peptide
MSQLERNIETIINTFHQYSVK

SEQ ID NO: 964 - protein, 21 aa, Artificial Sequence
  Description of Artificial Sequence: Synthetic peptide
MSQLERNIETIINTFHQYSVK

SEQ ID NO: 965 - protein, 21 aa, Artificial Sequence
  Description of Artificial Sequence: Synthetic peptide
MSQLERNIETIINTFHQYSVK

SEQ ID NO: 966 - protein, 21 aa, Artificial Sequence
  Description of Artificial Sequence: Synthetic peptide
MSQLERNIETIINTFHQYSVK

SEQ ID NO: 967 - protein, 21 aa, Artificial Sequence
  Description of Artificial Sequence: Synthetic peptide
MSQLERNIETIINTFHQYSVK

SEQ ID NO: 968 - protein, 21 aa, Artificial Sequence
  Description of Artificial Sequence: Synthetic peptide
MSQLERNIETIINTFHQYSVK

SEQ ID NO: 969 - protein, 21 aa, Artificial Sequence
  Description of Artificial Sequence: Synthetic peptide
MSQLERNIETIINTFHQYSVK

SEQ ID NO: 970 - protein, 21 aa, Artificial Sequence
  Description of Artificial Sequence: Synthetic peptide
MSQLERNIETIINTFHQYSVK

SEQ ID NO: 971 - protein, 21 aa, Artificial Sequence
  Description of Artificial Sequence: Synthetic peptide
MSQLERNIETIINTFHQYSVK

SEQ ID NO: 972 - protein, 13 aa, Artificial Sequence
  Description of Artificial Sequence: Synthetic peptide
QLSFEEFIMLMAR

SEQ ID NO: 973 - protein, 13 aa, Artificial Sequence
  Description of Artificial Sequence: Synthetic peptide
QLSFEEFIMLMAR

SEQ ID NO: 974 - protein, 13 aa, Artificial Sequence
  Description of Artificial Sequence: Synthetic peptide
QLSFEEFIMLMAR

SEQ ID NO: 975 - protein, 13 aa, Artificial Sequence
  Description of Artificial Sequence: Synthetic peptide
QLSFEEFIMLMAR

SEQ ID NO: 976 - protein, 13 aa, Artificial Sequence
  Description of Artificial Sequence: Synthetic peptide
QLSFEEFIMLMAR

SEQ ID NO: 977 - protein, 13 aa, Artificial Sequence
  Description of Artificial Sequence: Synthetic peptide
QLSFEEFIMLMAR

SEQ ID NO: 978 - protein, 15 aa, Artificial Sequence
  Description of Artificial Sequence: Synthetic peptide
VIEHIMEDLDTNADK

SEQ ID NO: 979 - protein, 15 aa, Artificial Sequence
  Description of Artificial Sequence: Synthetic peptide
VIEHIMEDLDTNADK

SEQ ID NO: 980 - protein, 28 aa, Artificial Sequence
  Description of Artificial Sequence: Synthetic peptide
VIEHIMEDLDTNADKQLSFEEFIMLMAR

SEQ ID NO: 981 - protein, 28 aa, Artificial Sequence
  Description of Artificial Sequence: Synthetic peptide
VIEHIMEDLDTNADKQLSFEEFIMLMAR

SEQ ID NO: 982 - protein, 28 aa, Artificial Sequence
  Description of Artificial Sequence: Synthetic peptide
VIEHIMEDLDTNADKQLSFEEFIMLMAR

SEQ ID NO: 983 - protein, 28 aa, Artificial Sequence
  Description of Artificial Sequence: Synthetic peptide
VIEHIMEDLDTNADKQLSFEEFIMLMAR

SEQ ID NO: 984 - protein, 28 aa, Artificial Sequence
  Description of Artificial Sequence: Synthetic peptide
VIEHIMEDLDTNADKQLSFEEFIMLMAR

SEQ ID NO: 985 - protein, 28 aa, Artificial Sequence
  Description of Artificial Sequence: Synthetic peptide
VIEHIMEDLDTNADKQLSFEEFIMLMAR

SEQ ID NO: 986 - protein, 28 aa, Artificial Sequence
  Description of Artificial Sequence: Synthetic peptide
VIEHIMEDLDTNADKQLSFEEFIMLMAR

SEQ ID NO: 987 - protein, 21 aa, Artificial Sequence
  Description of Artificial Sequence: Synthetic peptide
MHEGDEGPGHHHKPGLGEGTP

SEQ ID NO: 988 - protein, 21 aa, Artificial Sequence
  Description of Artificial Sequence: Synthetic peptide
MHEGDEGPGHHHKPGLGEGTP

SEQ ID NO: 989 - protein, 14 aa, Artificial Sequence
  Description of Artificial Sequence: Synthetic peptide
DPNHFRPAGLPEKY

SEQ ID NO: 990 - protein, 16 aa, Artificial Sequence
  Description of Artificial Sequence: Synthetic peptide
RGPGGAWAAEVISDAR

SEQ ID NO: 991 - protein, 14 aa, Artificial Sequence
  Description of Artificial Sequence: Synthetic peptide
SFFSFLGEAFDGAR

SEQ ID NO: 992 - protein, 17 aa, Artificial Sequence
  Description of Artificial Sequence: Synthetic peptide
SGKDPNHFRPAGLPEKY

SEQ ID NO: 993 - protein, 11 aa, Artificial Sequence
  Description of Artificial Sequence: Synthetic peptide
RLHYGENGVQK

SEQ ID NO: 994 - protein, 11 aa, Artificial Sequence
  Description of Artificial Sequence: Synthetic peptide
ISYQSSSTEER

SEQ ID NO: 995 - protein, 8 aa, Artificial Sequence
  Description of Artificial Sequence: Synthetic peptide
GPAYGLSR

SEQ ID NO: 996 - protein, 22 aa, Artificial Sequence
  Description of Artificial Sequence: Synthetic peptide
IEKQYDADLEQILIQWITTQCR

SEQ ID NO: 997 - protein, 11 aa, Artificial Sequence
  Description of Artificial Sequence: Synthetic peptide
ANRGPAYGLSR

SEQ ID NO: 998 - protein, 34 aa, Artificial Sequence
  Description of Artificial Sequence: Synthetic polypeptide
NMACVQRTLMNLGGLAVARDDGLFSGDPNWFPKK

SEQ ID NO: 999 - protein, 28 aa, Artificial Sequence
  Description of Artificial Sequence: Synthetic peptide
NVIGLQMGTNRGASQAGMTGYGMPRQIL

SEQ ID NO: 1000 - protein, 28 aa, Artificial Sequence
  Description of Artificial Sequence: Synthetic peptide
NVIGLQMGTNRGASQAGMTGYGMPRQIL

SEQ ID NO: 1001 - protein, 14 aa, Artificial Sequence
  Description of Artificial Sequence: Synthetic peptide
QMEQISQFLQAAER

SEQ ID NO: 1002 - protein, 32 aa, Artificial Sequence
  Description of Artificial Sequence: Synthetic polypeptide
QMEQISQFLQAAERYGINTTDIFQTVDLWEGK

SEQ ID NO: 1003 - protein, 19 aa, Artificial Sequence
  Description of Artificial Sequence: Synthetic peptide
QYDADLEQILIQWITTQCR

SEQ ID NO: 1004 - protein, 20 aa, Artificial Sequence
  Description of Artificial Sequence: Synthetic peptide
QYDADLEQILIQWITTQCRK

SEQ ID NO: 1005 - protein, 25 aa, Artificial Sequence
  Description of Artificial Sequence: Synthetic peptide
YGINTTDIFQTVDLWEGKNMACVQR

SEQ ID NO: 1006 - protein, 14 aa, Artificial Sequence
  Description of Artificial Sequence: Synthetic peptide
GASQAGMTGYGMPR

SEQ ID NO: 1007 - protein, 14 aa, Artificial Sequence
  Description of Artificial Sequence: Synthetic peptide
GASQAGMTGYGMPR

SEQ ID NO: 1008 - protein, 14 aa, Artificial Sequence
  Description of Artificial Sequence: Synthetic peptide
GASQAGMTGYGMPR

SEQ ID NO: 1009 - protein, 14 aa, Artificial Sequence
  Description of Artificial Sequence: Synthetic peptide
GASQAGMTGYGMPR

SEQ ID NO: 1010 - protein, 9 aa, Artificial Sequence
  Description of Artificial Sequence: Synthetic peptide
IQASTMAFK

SEQ ID NO: 1011 - protein, 23 aa, Artificial Sequence
  Description of Artificial Sequence: Synthetic peptide
IQASTMAFKQMEQISQFLQAAER

SEQ ID NO: 1012 - protein, 23 aa, Artificial Sequence
  Description of Artificial Sequence: Synthetic peptide
IQASTMAFKQMEQISQFLQAAER

SEQ ID NO: 1013 - protein, 10 aa, Artificial Sequence
  Description of Artificial Sequence: Synthetic peptide
KIQASTMAFK

SEQ ID NO: 1014 - protein, 11 aa, Artificial Sequence
  Description of Artificial Sequence: Synthetic peptide
NVIGLQMGTNR

SEQ ID NO: 1015 - protein, 22 aa, Artificial Sequence
  Description of Artificial Sequence: Synthetic peptide
NFSDNQLQEGKNVIGLQMGTNR

SEQ ID NO: 1016 - protein, 7 aa, Artificial Sequence
  Description of Artificial Sequence: Synthetic peptide
NMACVQR

SEQ ID NO: 1017 - protein, 7 aa, Artificial Sequence
  Description of Artificial Sequence: Synthetic peptide
NMACVQR

SEQ ID NO: 1018 - protein, 7 aa, Artificial Sequence
  Description of Artificial Sequence: Synthetic peptide
NMACVQR

SEQ ID NO: 1019 - protein, 7 aa, Artificial Sequence
  Description of Artificial Sequence: Synthetic peptide
NMACVQR

SEQ ID NO: 1020 - protein, 7 aa, Artificial Sequence
  Description of Artificial Sequence: Synthetic peptide
NMACVQR

SEQ ID NO: 1021 - protein, 7 aa, Artificial Sequence
  Description of Artificial Sequence: Synthetic peptide
NMACVQR

SEQ ID NO: 1022 - protein, 11 aa, Artificial Sequence
  Description of Artificial Sequence: Synthetic peptide
NVIGLQMGTNR

SEQ ID NO: 1023 - protein, 11 aa, Artificial Sequence
  Description of Artificial Sequence: Synthetic peptide
NVIGLQMGTNR

SEQ ID NO: 1024 - protein, 25 aa, Artificial Sequence
  Description of Artificial Sequence: Synthetic peptide
NVIGLQMGTNRGASQAGMTGYGMPR

SEQ ID NO: 1025 - protein, 14 aa, Artificial Sequence
  Description of Artificial Sequence: Synthetic peptide
QMEQISQFLQAAER

SEQ ID NO: 1026 - protein, 14 aa, Artificial Sequence
  Description of Artificial Sequence: Synthetic peptide
QMEQISQFLQAAER

SEQ ID NO: 1027 - protein, 14 aa, Artificial Sequence
  Description of Artificial Sequence: Synthetic peptide
QMEQISQFLQAAER

SEQ ID NO: 1028 - protein, 32 aa, Artificial Sequence; identical to SEQ ID NO: 1002
  Description of Artificial Sequence: Synthetic polypeptide

SEQ ID NO: 1029 - protein, 32 aa, Artificial Sequence; identical to SEQ ID NO: 1002
  Description of Artificial Sequence: Synthetic polypeptide

SEQ ID NO: 1030 - protein, 12 aa, Artificial Sequence
  Description of Artificial Sequence: Synthetic peptide
TLMNLGGLAVAR

SEQ ID NO: 1031 - protein, 12 aa, Artificial Sequence
  Description of Artificial Sequence: Synthetic peptide
TLMNLGGLAVAR

SEQ ID NO: 1032 - protein, 27 aa, Artificial Sequence
  Description of Artificial Sequence: Synthetic peptide
TLMNLGGLAVARDDGLFSGDPNWFPKK

SEQ ID NO: 1033 - protein, 25 aa, Artificial Sequence
  Description of Artificial Sequence: Synthetic peptide
YGINTTDIFQTVDLWEGKNMACVQR

SEQ ID NO: 1034 - protein, 21 aa, Artificial Sequence
  Description of Artificial Sequence: Synthetic peptide
DGTVLCELINALYPEGQAPVK

SEQ ID NO: 1035 - protein, 8 aa, Artificial Sequence
  Description of Artificial Sequence: Synthetic peptide
GPAYGLSR

SEQ ID NO: 1036 - protein, 11 aa, Artificial Sequence
  Description of Artificial Sequence: Synthetic peptide
NFSDNQLQEGK

SEQ ID NO: 1037 - protein, 14 aa, Artificial Sequence
  Description of Artificial Sequence: Synthetic peptide
SDNQLQEGKNVIGL

SEQ ID NO: 1038 - protein, 14 aa, Artificial Sequence
  Description of Artificial Sequence: Synthetic peptide
GASQAGMTGYGMPR

SEQ ID NO: 1039 - protein, 18 aa, Artificial Sequence
  Description of Artificial Sequence: Synthetic peptide
DSATMSLDPEEEAEHPIK

SEQ ID NO: 1040 - protein, 21 aa, Artificial Sequence
  Description of Artificial Sequence: Synthetic peptide
EGDVQLNFDMPFIFAEVNADR

SEQ ID NO: 1041 - protein, 25 aa, Artificial Sequence
  Description of Artificial Sequence: Synthetic peptide
GLGSNERLEFIVSTGPYPSESAMTK

SEQ ID NO: 1042 - protein, 12 aa, Artificial Sequence
  Description of Artificial Sequence: Synthetic peptide
GQNFQVLMIMNK

SEQ ID NO: 1043 - protein, 18 aa, Artificial Sequence
  Description of Artificial Sequence: Synthetic peptide
LEFIVSTGPYPSESAMTK

SEQ ID NO: 1044 - protein, 27 aa, Artificial Sequence
  Description of Artificial Sequence: Synthetic peptide
LKPNTPFAATSSMGLETEEQEPSIIGK

SEQ ID NO: 1045 - protein, 17 aa, Artificial Sequence
  Description of Artificial Sequence: Synthetic peptide
MDVTDKYKYPEGSDQER

SEQ ID NO: 1046 - protein, 17 aa, Artificial Sequence
  Description of Artificial Sequence: Synthetic peptide
NLSVDVYYDPMGNPLDK

SEQ ID NO: 1047 - protein, 9 aa, Artificial Sequence
  Description of Artificial Sequence: Synthetic peptide
VAGMLAVGK

SEQ ID NO: 1048 - protein, 17 aa, Artificial Sequence
  Description of Artificial Sequence: Synthetic peptide
YTMALQIFSQGGISSVK

SEQ ID NO: 1049 - protein, 10 aa, Artificial Sequence
  Description of Artificial Sequence: Synthetic peptide
ESLDLRAHLK

SEQ ID NO: 1050 - protein, 14 aa, Artificial Sequence
  Description of Artificial Sequence: Synthetic peptide
ISADAMMQALLGAR

SEQ ID NO: 1051 - protein, 12 aa, Artificial Sequence
  Description of Artificial Sequence: Synthetic peptide
NIDALSGMEGRK

SEQ ID NO: 1052 - protein, 14 aa, Artificial Sequence
  Description of Artificial Sequence: Synthetic peptide
ISADAMMQALLGAR

SEQ ID NO: 1053 - protein, 14 aa, Artificial Sequence
  Description of Artificial Sequence: Synthetic peptide
ISADAMMQALLGAR

SEQ ID NO: 1054 - protein, 14 aa, Artificial Sequence
  Description of Artificial Sequence: Synthetic peptide
ISADAMMQALLGAR

SEQ ID NO: 1055 - protein, 14 aa, Artificial Sequence
  Description of Artificial Sequence: Synthetic peptide
ISADAMMQALLGAR

SEQ ID NO: 1056 - protein, 14 aa, Artificial Sequence
  Description of Artificial Sequence: Synthetic peptide
ISAVAMMQALLGAR

SEQ ID NO: 1057 - protein, 14 aa, Artificial Sequence
  Description of Artificial Sequence: Synthetic peptide
ISAVAMMQALLGAR

SEQ ID NO: 1058 - protein, 14 aa, Artificial Sequence
  Description of Artificial Sequence: Synthetic peptide
ISAVAMMQALLGAR

SEQ ID NO: 1059 - protein, 12 aa, Artificial Sequence
  Description of Artificial Sequence: Synthetic peptide
KNIDALSGMEGR

SEQ ID NO: 1060 - protein, 13 aa, Artificial Sequence
  Description of Artificial Sequence: Synthetic peptide
KNIDALSGMEGRK

SEQ ID NO: 1061 - protein, 11 aa, Artificial Sequence
  Description of Artificial Sequence: Synthetic peptide
NIDALSGMEGR

SEQ ID NO: 1062 - protein, 12 aa, Artificial Sequence
  Description of Artificial Sequence: Synthetic peptide
NIDALSGMEGRK

SEQ ID NO: 1063 - protein, 16 aa, Artificial Sequence
  Description of Artificial Sequence: Synthetic peptide
VRISADAMMQALLGAR

SEQ ID NO: 1064 - protein, 16 aa, Artificial Sequence
  Description of Artificial Sequence: Synthetic peptide
VRISADAMMQALLGAR

SEQ ID NO: 1065 - protein, 16 aa, Artificial Sequence
  Description of Artificial Sequence: Synthetic peptide
VRISADAMMQALLGAR

SEQ ID NO: 1066 - protein, 8 aa, Artificial Sequence
  Description of Artificial Sequence: Synthetic peptide
AKESLDLR

SEQ ID NO: 1067 - protein, 9 aa, Artificial Sequence
  Description of Artificial Sequence: Synthetic peptide
ADGSSDAAR

SEQ ID NO: 1068 - protein, 9 aa, Artificial Sequence
  Description of Artificial Sequence: Synthetic peptide
ADGSSDAAR

SEQ ID NO: 1069 - protein, 11 aa, Artificial Sequence
  Description of Artificial Sequence: Synthetic peptide
NIDALSGMEGR

SEQ ID NO: 1070 - protein, 8 aa, Artificial Sequence
  Description of Artificial Sequence: Synthetic peptide
TLLLQIAK

SEQ ID NO: 1071 - protein, 8 aa, Artificial Sequence
  Description of Artificial Sequence: Synthetic peptide
TLLLQIAK

SEQ ID NO: 1072 - protein, 11 aa, Artificial Sequence
  Description of Artificial Sequence: Synthetic peptide
NIDALSGMEGR

SEQ ID NO: 1073 - protein, 11 aa, Artificial Sequence
  Description of Artificial Sequence: Synthetic peptide
NIDALSGMEGR

SEQ ID NO: 1074 - protein, 12 aa, Artificial Sequence
  Description of Artificial Sequence: Synthetic peptide
ATVMLYDDGNKR

SEQ ID NO: 1075 - protein, 26 aa, Artificial Sequence
  Description of Artificial Sequence: Synthetic peptide
DESANQEEPEARVPAQSESVRRPWEK

SEQ ID NO: 1076 - protein, 26 aa, Artificial Sequence
  Description of Artificial Sequence: Synthetic peptide
DESANQEEPEARVPAQSESVRRPWEK

SEQ ID NO: 1077 - protein, 26 aa, Artificial Sequence
  Description of Artificial Sequence: Synthetic peptide
DESANQEEPEARVPAQSESVRRPWEK

SEQ ID NO: 1078 - protein, 26 aa, Artificial Sequence
  Description of Artificial Sequence: Synthetic peptide
DESANQEEPEARVPAQSESVRRPWEK

SEQ ID NO: 1079 - protein, 15 aa, Artificial Sequence
  Description of Artificial Sequence: Synthetic peptide
MQPDQQVVINCAIVR

SEQ ID NO: 1080 - protein, 14 aa, Artificial Sequence
  Description of Artificial Sequence: Synthetic peptide
VKEEIIEAFVQELR

SEQ ID NO: 1081 - protein, 9 aa, Artificial Sequence
  Description of Artificial Sequence: Synthetic peptide
VPAQSESVR

SEQ ID NO: 1082 - protein, 13 aa, Artificial Sequence
  Description of Artificial Sequence: Synthetic peptide
VQIYHNPTANSFR

SEQ ID NO: 1083 - protein, 12 aa, Artificial Sequence
  Description of Artificial Sequence: Synthetic peptide
YNQATPNFHQWR

SEQ ID NO: 1084 - protein, 11 aa, Artificial Sequence
  Description of Artificial Sequence: Synthetic peptide
ATVMLYDDGNK

SEQ ID NO: 1085 - protein, 12 aa, Artificial Sequence
  Description of Artificial Sequence: Synthetic peptide
ATVMLYDDGNKR

SEQ ID NO: 1086 - protein, 15 aa, Artificial Sequence
  Description of Artificial Sequence: Synthetic peptide
MQPDQQVVINCAIVR

SEQ ID NO: 1087 - protein, 16 aa, Artificial Sequence
  Description of Artificial Sequence: Synthetic peptide
SGGGGLMEEMNAMLAR

SEQ ID NO: 1088 - protein, 16 aa, Artificial Sequence
  Description of Artificial Sequence: Synthetic peptide
SGGGGLMEEMNAMLAR

SEQ ID NO: 1089 - protein, 16 aa, Artificial Sequence
  Description of Artificial Sequence: Synthetic peptide
SGGGGLMEEMNAMLAR

SEQ ID NO: 1090 - protein, 16 aa, Artificial Sequence
  Description of Artificial Sequence: Synthetic peptide
KVSKQEEASGGPTAPK

SEQ ID NO: 1091 - protein, 27 aa, Artificial Sequence
  Description of Artificial Sequence: Synthetic peptide
MKSSSSVTTSETQPCTPSSSDYSDLQR

SEQ ID NO: 1092 - protein, 27 aa, Artificial Sequence
  Description of Artificial Sequence: Synthetic peptide
MKSSSSVTTSETQPCTPSSSDYSDLQR

SEQ ID NO: 1093 - protein, 27 aa, Artificial Sequence
  Description of Artificial Sequence: Synthetic peptide
MKSSSSVTTSETQPCTPSSSDYSDLQR

SEQ ID NO: 1094 - protein, 27 aa, Artificial Sequence
  Description of Artificial Sequence: Synthetic peptide
MKSSSSVTTSETQPCTPSSSDYSDLQR

SEQ ID NO: 1095 - protein, 27 aa, Artificial Sequence
  Description of Artificial Sequence: Synthetic peptide
MKSSSSVTTSETQPCTPSSSDYSDLQR

SEQ ID NO: 1096 - protein, 27 aa, Artificial Sequence
  Description of Artificial Sequence: Synthetic peptide
MKSSSSVTTSETQPCTPSSSDYSDLQR

SEQ ID NO: 1097 - protein, 27 aa, Artificial Sequence
  Description of Artificial Sequence: Synthetic peptide
MKSSSSVTTSETQPCTPSSSDYSDLQR

SEQ ID NO: 1098 - protein, 34 aa, Artificial Sequence
  Description of Artificial Sequence: Synthetic polypeptide
QEEASGGPTAPKAESGRSGGGGLMEEMNAMLARR

SEQ ID NO: 1099 - protein, 17 aa, Artificial Sequence
  Description of Artificial Sequence: Synthetic peptide
GETILENIEFLEDTDMK

SEQ ID NO: 1100 - protein, 13 aa, Artificial Sequence
  Description of Artificial Sequence: Synthetic peptide
LHIDEMDSVPTVR

SEQ ID NO: 1101 - protein, 17 aa, Artificial Sequence
  Description of Artificial Sequence: Synthetic peptide
MEDSGVYLCEGINQAGR

SEQ ID NO: 1102 - protein, 15 aa, Artificial Sequence
  Description of Artificial Sequence: Synthetic peptide
SLEMTFIPTIEDTGK

SEQ ID NO: 1103 - protein, 32 aa, Artificial Sequence
  Description of Artificial Sequence: Synthetic polypeptide
VTNEGTTSTLTMNPVSFGNEHSYLCTATCESR

SEQ ID NO: 1104 - protein, 19 aa, Artificial Sequence
  Description of Artificial Sequence: Synthetic peptide
VGSQLRSLTLDVQGRENNK

SEQ ID NO: 1105 - protein, 19 aa, Artificial Sequence
  Description of Artificial Sequence: Synthetic peptide
VGSQLRSLTLDVQGRENNK

SEQ ID NO: 1106 - protein, 21 aa, Artificial Sequence
  Description of Artificial Sequence: Synthetic peptide
LDNGNLQHLSGNATLTLIAMR

SEQ ID NO: 1107 - protein, 330 aa, Homo sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 1108 - protein, 317 aa, Homo sapiens [sequence omitted]

SEQ ID NO: 1109 - protein, 117 aa, Homo sapiens
MGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANR

SEQ ID NO: 1110 - protein, 266 aa, Homo sapiens
MRTWNSGGTKCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGK

SEQ ID NO: 1111 - protein, 330 aa, Homo sapiens; identical to SEQ ID NO: 1107

SEQ ID NO: 1112 - protein, 331 aa, Homo sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKKKKK

SEQ ID NO: 1113 - protein, 330 aa, Homo sapiens [sequence omitted]

SEQ ID NO: 1114 - protein, 330 aa, Homo sapiens [sequence omitted]

SEQ ID NO: 1115 - protein, 329 aa, Homo sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 1116 - protein, 160 aa, Homo sapiens [sequence omitted]

SEQ ID NO: 1117 - protein, 92 aa, Homo sapiens
MTKLEEHLEGIVNIFHQYSVRKGHFDTLSKGELKQLLTKELANTIKNIKDKAVIDEIFQGLDANQDEQVDFQEFISLVAIALKAAHYHTHKE

SEQ ID NO: 1118 - protein, 193 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 1119 - protein, 193 aa, Homo sapiens; identical to SEQ ID NO: 1118

SEQ ID NO: 1120 - protein, 187 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKSWHKACFRCAKCGKGLESTTLADKDGEIYCKGCYAKNFGPKGFGFGQGAGALVHSE

SEQ ID NO: 1121 - protein, 140 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKGLF

SEQ ID NO: 1122 - protein, 159 aa, Homo sapiens
PNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKVRWLLGMRGMGGDIFLKCGFQNF

SEQ ID NO: 1123 - protein, 193 aa, Homo sapiens; identical to SEQ ID NO: 1118

SEQ ID NO: 1124 - protein, 191 aa, Homo sapiens
MYAKRPESFSCKKLAMSKKVTPASTQCVRFPFPSTVVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 1125 - protein, 168 aa, Homo sapiens
EGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 1126 - protein, 432 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 1127 - protein, 435 aa, Homo sapiens
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 1128 - protein, 437 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 1129 - protein, 335 aa, Homo sapiens
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGG

SEQ ID NO: 1130 - protein, 435 aa, Homo sapiens [sequence omitted]

SEQ ID NO: 1131 - protein, 412 aa, Homo sapiens
METFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 1132 - protein, 199 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 1133 - protein, 140 aa, Homo sapiens
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 1134 - protein, 140 aa, Homo sapiens; identical to SEQ ID NO: 1133

SEQ ID NO: 1135 - protein, 707 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 1136 - protein, 594 aa, Homo sapiens [sequence omitted]

SEQ ID NO: 1137 - protein, 101 aa, Homo sapiens
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 1138 - protein, 101 aa, Homo sapiens; identical to SEQ ID NO: 1137

SEQ ID NO: 1139 - protein, 226 aa, Homo sapiens
MSETAPAETATPAPVEKSPAKKKATKKAAGAGAAKRKATGPPVSELITKAVAASKERNGLSLAALKKALAAGGYDVEKNNSRIKLGLKSLVSKGTLVQTKGTGASGSFKLNKKAASGEAKPKAKKAGAAKAKKPAGATPKKAKKAAGAKKAVKKTPKKAKKPAAAGVKKVAKSPKKAKAAAKPKKATKSPAKPKAVKPKAAKPKAAKPKAAKPKAAKAKKAAAKKK

SEQ ID NO: 1140 - protein, 469 aa, Homo sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 1141 - protein, 380 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 1142 - protein, 1935 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 1143 - protein, 1939 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQVLALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 1144 - protein, 1939 aa, Homo sapiens; identical to SEQ ID NO: 1143

SEQ ID NO: 1145 - protein, 181 aa, Homo sapiens
SHSMRYFYTSVSRPGRGEPRFIAVGYVDDTQFVRFDSDAASQRMEPRAPWIEQEGPEYWDRNTRNVKAQSQTDRVDLETLRGYYNQSEAGSHTIQMMYGCDVGSDGRFLRGYRQDAYDGKDYIALKEDLRSWTAADMAAQTTKHKWEAAHVAEQWRAYLEGTCVEWLRRYLENGKETLQRT

SEQ ID NO: 1146 - protein, 181 aa, Homo sapiens; identical to SEQ ID NO: 1145

SEQ ID NO: 1147 - protein, 181 aa, Homo sapiens; identical to SEQ ID NO: 1145

SEQ ID NO: 1148 - protein, 347 aa, Homo sapiens
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 1149 - protein, 98 aa, Homo sapiens
MIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 1150 - protein, 63 aa, Homo sapiens
MIPGGLSEAKPATPEIQEIVDKVKPQLEEKTNETYGKLEAVQYKTQVVAGTNYYIKVRVQHLL

SEQ ID NO: 1151 - protein, 98 aa, Homo sapiens; identical to SEQ ID NO: 1149

SEQ ID NO: 1152 - protein, 333 aa, Homo sapiens [sequence omitted]

SEQ ID NO: 1153 - protein, 333 aa, Homo sapiens [sequence omitted]

SEQ ID NO: 1154 - protein, 333 aa, Homo sapiens [sequence omitted]

SEQ ID NO: 1155 - protein, 225 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATVSGAPCHHSSSAFGRWTL

SEQ ID NO: 1156 - protein, 617 aa, Homo sapiens
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 1157 - protein, 128 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 1158 - protein, 128 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 1159 - protein, 128 aa, Homo sapiens; identical to SEQ ID NO: 1158

SEQ ID NO: 1160 - protein, 122 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGMYYYLSLDSYWSF

SEQ ID NO: 1161 - protein, 146 aa, Homo sapiens
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 1162 - protein, 647 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 1163 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 1164 - protein, 739 aa, Homo sapiens; identical to SEQ ID NO: 1163

SEQ ID NO: 1165 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQTGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 1166 - protein, 242 aa, Homo sapiens
MSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 1167 - protein, 242 aa, Homo sapiens; identical to SEQ ID NO: 1166

SEQ ID NO: 1168 - protein, 217 aa, Homo sapiens
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 1169 - protein, 195 aa, Homo sapiens
MSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 1170 - protein, 217 aa, Homo sapiens [sequence omitted]

SEQ ID NO: 1171 - protein, 170 aa, Homo sapiens
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 1172 - protein, 1049 aa, Homo sapiens
MDWSFFRVVAMLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 1173 - protein, 693 aa, Homo sapiens
MAALGVQSINWQTAFNRQAHHTDKFSSQELILRRGQNFQVLMIMNKGLGSNERLEFIVSTGPYPSESAMTKAVFPLSNGSSGGWSAVLQASNGNTLTISISSPASAPIGRYTMALQIFSQGGISSVKLGTFILLFNPWLNVDSVFMGNHAEREEYVQEDAGIIFVGSTNRIGMIGWNFGQFEEDILSICLSILDRSLNFRRDAATDVASRNDPKYVGRVLSAMINSNDDNGVLAGNWSGTYTGGRDPRSWNGSVEILKNWKKSGFSPVRYGQCWVFAGTLNTALRSLGIPSRVITNFNSAHDTDRNLSVDVYYDPMGNPLDKGSDSVWNFHVWNEGWFVRSDLGPSYGGWQVLDATPQERSQGVFQCGPASVIGVREGDVQLNFDMPFIFAEVNADRITWLYDNTTGKQWKNSVNSHTIGRYISTKAVGSNARMDVTDKYKYPEGSDQERQVFQKALGKLKPNTPFAATSSMGLETEEQEPSIIGKLKVAGMLAVGKEVNLVLLLKNLSRDTKTVTVNMTAWTIIYNGTLVHEVWKDSATMSLDPEEEAEHPIKISYAQYEKYLKSDNMIRITAVCKVPDESEVVVERDIILDNPTLTLEVLNEARVRKPVNVQMLFSNPLDEPVRDCVLMVEGSGLLLGNLKIDVPTLGPKEGSRVRFDILPSRSGTKQLLADFSCNKFPAIKAMLSIDVAE

SEQ ID NO: 1174 - protein, 533 aa, Homo sapiens [sequence omitted]

SEQ ID NO: 1175 - protein, 693 aa, Homo sapiens; identical to SEQ ID NO: 1173

SEQ ID NO: 1176 - protein, 455 aa, Homo sapiens
MSSSGLNSEKVAALIQKLNSDPQFVLAQNVGTTHDLLDICLKRATVQRAQHVFQHAVPQEGKPITNQKSSGRCWIFSCLNVMRLPFMKKLNIEEFEFSQSYLFFWDKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 1177 - protein, 138 aa, Homo sapiens
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 1178 - protein, 107 aa, Homo sapiens
MFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 1179 - protein, 163 aa, Homo sapiens
MVKSLERENIRKMQVAGLGPNQDPLLSGWVPGPSLSHHATPCTAAASPQTGCGRPWGRRGGLGQDFGSFGGSDEIRVPLPCARLFSAPSSPGQERPRRQGLMFRCSASCCEDSQASMKQVHQCIERCHVPLAQAQALVTSELEKFQDRLARCTMHCNDKAKDS

SEQ ID NO: 1180 - protein, 90 aa, Homo sapiens
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 1181 - protein, 90 aa, Homo sapiens; identical to SEQ ID NO: 1180

SEQ ID NO: 1182 - protein, 650 aa, Homo sapiens
MELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 1183 - protein, 777 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRCGWLGVAAGTGLREASRTPQASRCQRPVLPCRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 1184 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 1185 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIGNGQSG

SEQ ID NO: 1186 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 1187 - protein, 199 aa, Homo sapiens [sequence omitted]

SEQ ID NO: 1188 - protein, 507 aa, Homo sapiens
MDPKLGRMAASLLAVLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPIILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 1189 - protein, 507 aa, Homo sapiens [sequence omitted]

SEQ ID NO: 1190 - protein, 493 aa, Homo sapiens
MDPKLGRMAASLLAVLLLLLERGMFSSPSPPPALLEKVFQYIDLHQDEFVQTLKEWVAIESDSVQPVPRFRQELFRMMAVAADTLQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 1191 - protein, 527 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAREKANL

SEQ ID NO: 1192 - protein, 527 aa, Homo sapiens; identical to SEQ ID NO: 1191

SEQ ID NO: 1193 - protein, 2871 aa, Homo sapiens
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 1194 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1195 - protein, 335 aa, Homo sapiens [sequence omitted]

SEQ ID NO: 1196 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1197 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1198 - protein, 154 aa, Homo sapiens [sequence omitted]

SEQ ID NO: 1199 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 1200 - protein, 114 aa, Homo sapiens; identical to SEQ ID NO: 1199

SEQ ID NO: 1201 - protein, 462 aa, Homo sapiens
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 1202 - protein, 457 aa, Homo sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 1203 - protein, 103 aa, Homo sapiens [sequence omitted]

SEQ ID NO: 1204 - protein, 103 aa, Homo sapiens [sequence omitted]

SEQ ID NO: 1205 - protein, 103 aa, Homo sapiens [sequence omitted]

SEQ ID NO: 1206 - protein, 219 aa, Homo sapiens
MSETAPAAPAAPAPAEKTPVKKKARKSAGAAKRKASGPPVSELITKAVAASKERSGVSLAALKKALAAAGYDVEKNNSRIKLGLKSLVSKGTLVQTKGTGASGSFKLNKKAASGEAKPKAKKAGAAKAKKPAGAAKKPKKATGAATPKKSAKKTPKKAKKPAAAAGAKKAKSPKKAKAAKPKKAPKSPAKAKAVKPKAAKPKTAKPKAAKPKKAAAKKK

SEQ ID NO: 1207 - protein, 221 aa, Homo sapiens
MSETAPLAPTIPAPAEKTPVKKKAKKAGATAGKRKASGPPVSELITKAVAASKERSGVSLAALKKALAAAGYDVEKNNSRIKLGLKSLVSKGTLVQTKGTGASGSFKLNKKAASGEGKPKAKKAGAAKPRKPAGAAKKPKKVAGAATPKKSIKKTPKKVKKPATAAGTKKVAKSAKKVKTPQPKKAAKSPAKAKAPKPKAAKPKSGKPKVTKAKKAAPKKK

SEQ ID NO: 1208 - protein, 213 aa, Homo sapiens [sequence omitted]

SEQ ID NO: 1209 - protein, 219 aa, Homo sapiens
MSETAPAAPAAPAPAEKTPVKKKARKSAGAAKRKASGPPVSELITKAVTASKERSGVSLAALKKALAAAGYDVEKNNSRIKLGLKSLVSKGTPVQTKGTGASGSFKLNKKAASGEAKPKAKKAGAAKAKKPAGAAKKPKKATGAATPKKSAKKTPKKAKKPAAAAGAKKAKSPKKAKAAKPKKAPKSPAKAKAVKPKAAKPKTAKPKAAKPKKAAAKKK

SEQ ID NO: 1210 - protein, 219 aa, Homo sapiens; identical to SEQ ID NO: 1206

SEQ ID NO: 1211 - protein, 213 aa, Homo sapiens [sequence omitted]

SEQ ID NO: 1212 - protein, 219 aa, Homo sapiens
MSETAPAAPAAPAPAEKTPVKKKARKSAGAAKRKASGPPVSELITKAVAASKERSGVSLAALKKALAAAGYDVEKNNSRIKLGLKSLVSKGTLVQTKGTGASGSFKLNKKAASGEAKPKAKKAGAAKAKKPAGAAKKPKKVTGAATPKKSAKKTPKKAKKPAAAAGAKKAKSPKKAKAAKPKKAPKSPAKAKAVKPKAAKPKTAKPKAAKPKKAAAKKK

SEQ ID NO: 1213 - protein, 219 aa, Homo sapiens
MSETAPAAPAAPAPAEKTPVKKKARKSAGAAKRKASGPPVSELITKVVAASKERSGVSLAALKKALAAAGYDVEKNNSRIKLGLKSLVSKGTLVQTKGTGASGSFKLNKKAASGEAKPKAKKAGAAKAKKPAGAAKKPKKATGAATPKKSAKKTPKKAKKPAAAAGAKKAKSPKKAKAAKPKKAPKSPAKAKAVKPKAAKPKTAKPKAAKPKKAAAKKK

SEQ ID NO: 1214 - protein, 101 aa, Homo sapiens
MSNTQAERSIIGMIDMFHKYTRRDDKIEKPSLLTMMKENFPNFLSACDKKGTNYLADVFEKKDKNEDKKIDFSEFLSLLGDIATDYHKQSHGAAPCSGGSQ

SEQ ID NO: 1215 - protein, 100 aa, Homo sapiens
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 1216 - protein, 261 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 1217 - protein, 709 aa, Homo sapiens [sequence omitted]

SEQ ID NO: 1218 - protein, 259 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 1219 - protein, 258 aa, Homo sapiens
SEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 1220 - protein, 257 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQTSMDGEAGLCWCVYPWNGKRIPGSPEIRGDPNCQIYFNVQN

SEQ ID NO: 1221 - protein, 259 aa, Homo sapiens; identical to SEQ ID NO: 1218

SEQ ID NO: 1222 - protein, 259 aa, Homo sapiens [sequence omitted]

SEQ ID NO: 1223 - protein, 956 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 1224 - protein, 198 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 1225 - protein, 183 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLAVTRLSPTWMTARNISPNTIRLANG

SEQ ID NO: 1226 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 1227 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 1228 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 1229 - protein, 338 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 1230 - protein, 134 aa, Homo sapiens
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 1231 - protein, 122 aa, Homo sapiens
MKLLTGLVFCSLVLGVSSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 1232 - protein, 147 aa, Homo sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 1233 - protein, 484 aa, Homo sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPSSPVSQ

SEQ ID NO: 1234 - protein, 105 aa, Homo sapiens
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 1235 - protein, 114 aa, Homo sapiens
MVIRVYIASSSGSTAIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 1236 - protein, 16 aa, Artificial Sequence
  Description of Artificial Sequence: Synthetic peptide
SETAPAETATPAPVEK

SEQ ID NO: 1237 - protein, 20 aa, Artificial Sequence
  Description of Artificial Sequence: Synthetic peptide
SETAPAETATPAPVEKSPAK

SEQ ID NO: 1238 - protein, 20 aa, Artificial Sequence
  Description of Artificial Sequence: Synthetic peptide
SETAPAETATPAPVEKSPAK

SEQ ID NO: 1239 - protein, 16 aa, Artificial Sequence
  Description of Artificial Sequence: Synthetic peptide
SETAPAETATPAPVEK

SEQ ID NO: 1240 - protein, 20 aa, Artificial Sequence
  Description of Artificial Sequence: Synthetic peptide
SETAPAETATPAPVEKSPAK

SEQ ID NO: 1241 - protein, 21 aa, Artificial Sequence
  Description of Artificial Sequence: Synthetic peptide
SETAPAETATPAPVEKSPAKK

SEQ ID NO: 1242 - protein, 20 aa, Artificial Sequence
  Description of Artificial Sequence: Synthetic peptide
SETAPAETATPAPVEKSPAK

SEQ ID NO: 1243 - protein, 15 aa, Artificial Sequence
  Description of Artificial Sequence: Synthetic peptide
ALAAAGYDVEKNNSR

SEQ ID NO: 1244 - protein, 11 aa, Artificial Sequence
  Description of Artificial Sequence: Synthetic peptide
ERSGVSLAALK

SEQ ID NO: 1245 - protein, 11 aa, Artificial Sequence
  Description of Artificial Sequence: Synthetic peptide
ERSGVSLAALK

SEQ ID NO: 1246 - protein, 35 aa, Artificial Sequence
  Description of Artificial Sequence: Synthetic polypeptide
LMEDLDRNKDQEVNFQEYVTFLGALALIYNEALKG

SEQ ID NO: 1247 - protein, 13 aa, Homo sapiens
LGHPDTLNQGEFK

SEQ ID NO: 1248 - protein, 15 aa, Homo sapiens
NIETIINTFHQYSVK

SEQ ID NO: 1249 - protein, 8 aa, Homo sapiens
LTWASHEK

SEQ ID NO: 1250 - protein, 9 aa, Homo sapiens
YYGYTGAFR

SEQ ID NO: 1251 - protein, 14 aa, Homo sapiens
YLGPQYVAGITNLK

SEQ ID NO: 1252 - protein, 13 aa, Homo sapiens
LRPVAAEVYGTER

SEQ ID NO: 1253 - protein, 9 aa, Homo sapiens
IGKPAPDFK

SEQ ID NO: 1254 - protein, 9 aa, Homo sapiens
LSEDYGVLK

SEQ ID NO: 1255 - protein, 8 aa, Homo sapiens
TDEGIAYR

SEQ ID NO: 1256 - protein, 10 aa, Homo sapiens
ISNIPDEYFK

SEQ ID NO: 1257 - protein, 8 aa, Homo sapiens
FNALQYLR

SEQ ID NO: 1258 - protein, 11 aa, Homo sapiens
SLEDLQLTHNK

SEQ ID NO: 1259 - protein, 8 aa, Homo sapiens
APYPNYDR

SEQ ID NO: 1260 - protein, 12 aa, Homo sapiens
ELPSLQHPNEQK

SEQ ID NO: 1261 - protein, 10 aa, Homo sapiens
LLPAQLPAEK

SEQ ID NO: 1262 - protein, 13 aa, Homo sapiens
ALGFEAAESSLTK

SEQ ID NO: 1263 - protein, 11 aa, Homo sapiens
LEFDLLYPAIK

SEQ ID NO: 1264 - protein, 8 aa, Homo sapiens
LGSTQIVK

SEQ ID NO: 1265 - protein, 10 aa, Homo sapiens
DINTFIHGNK

SEQ ID NO: 1266 - protein, 16 aa, Homo sapiens
YTHFLTQHYDAKPQGR

SEQ ID NO: 1267 - protein, 10 aa, Homo sapiens
GHYQNVVEVR

SEQ ID NO: 1268 - protein, 13 aa, Homo sapiens
LPSEFSQFPHGQK

SEQ ID NO: 1269 - protein, 14 aa, Homo sapiens
DIFSTQDELLVYNK

SEQ ID NO: 1270 - protein, 4 aa, Homo sapiens
SDSY

SEQ ID NO: 1271 - protein, 5 aa, Homo sapiens
DALQA

SEQ ID NO: 1272 - protein, 7 aa, Homo sapiens
EFLSLLG

SEQ ID NO: 1273 - protein, 4 aa, Homo sapiens
PDTH

SEQ ID NO: 1274 - protein, 5 aa, Homo sapiens
ELQAE

SEQ ID NO: 1275 - protein, 5 aa, Homo sapiens
LFQYS

SEQ ID NO: 1276 - protein, 6 aa, Homo sapiens
TTLFQY

SEQ ID NO: 1277 - protein, 9 aa, Homo sapiens
ATTLFQYSG

SEQ ID NO: 1278 - protein, 4 aa, Homo sapiens
FQDN

SEQ ID NO: 1279 - protein, 4 aa, Homo sapiens
NFQD

SEQ ID NO: 1280 - protein, 4 aa, Homo sapiens
DNQF

SEQ ID NO: 1281 - protein, 8 aa, Homo sapiens
LVLFPGDL

SEQ ID NO: 1282 - protein, 7 aa, Homo sapiens
VLFPGDL

SEQ ID NO: 1283 - protein, 7 aa, Homo sapiens
LVLFPGD

SEQ ID NO: 1284 - protein, 5 aa, Homo sapiens
LGPAL

SEQ ID NO: 1285 - protein, 5 aa, Homo sapiens
GPALL

SEQ ID NO: 1286 - protein, 6 aa, Homo sapiens
LGADVA

SEQ ID NO: 1287 - protein, 8 aa, Homo sapiens
LGADVAQV

SEQ ID NO: 1288 - protein, 4 aa, Homo sapiens
PNAW

SEQ ID NO: 1289 - protein, 7 aa, Homo sapiens
DPNAWVE

SEQ ID NO: 1290 - protein, 8 aa, Homo sapiens
IVVWNNIG

SEQ ID NO: 1291 - protein, 7 aa, Homo sapiens
PEGPAVA

SEQ ID NO: 1292 - protein, 4 aa, Homo sapiens
PSLA

SEQ ID NO: 1293 - protein, 4 aa, Homo sapiens
YGYG

SEQ ID NO: 1294 - protein, 5 aa, Homo sapiens
SGSTA

SEQ ID NO: 1295 - protein, 6 aa, Homo sapiens
TAPPGS

SEQ ID NO: 1296 - protein, 6 aa, Homo sapiens
YAFLGL

SEQ ID NO: 1297 - protein, 6 aa, Homo sapiens
AVYAFL

SEQ ID NO: 1298 - protein, 8 aa, Homo sapiens
AVYAFLGL

SEQ ID NO: 1299 - protein, 10 aa, Homo sapiens
LAWINAVSAF

SEQ ID NO: 1300 - protein, 11 aa, Homo sapiens
VLAWINAVSAF

SEQ ID NO: 1301 - protein, 6 aa, Homo sapiens
VVVDFS

SEQ ID NO: 1302 - protein, 4 aa, Homo sapiens
ATWC

SEQ ID NO: 1303 - protein, 5 aa, Homo sapiens
FLDAQ

SEQ ID NO: 1304 - protein, 8 aa, Homo sapiens
EQLTPLIK

SEQ ID NO: 1305 - protein, 9 aa, Homo sapiens
SPELQAEAK

SEQ ID NO: 1306 - protein, 9 aa, Homo sapiens
GDFQFNISR

SEQ ID NO: 1307 - protein, 9 aa, Homo sapiens
WVGYGQDSR

SEQ ID NO: 1308 - protein, 9 aa, Homo sapiens
IDPNAWVER

SEQ ID NO: 1309 - protein, 8 aa, Homo sapiens
NGPEQWSK

SEQ ID NO: 1310 - protein, 10 aa, Homo sapiens
YSSLAEAASK

SEQ ID NO: 1311 - protein, 9 aa, Homo sapiens
GGPFSDSYR

SEQ ID NO: 1312 - protein, 9 aa, Homo sapiens
VLDALQAIK

SEQ ID NO: 1313 - protein, 11 aa, Homo sapiens
STINLAQTGER

SEQ ID NO: 1314 - protein, 8 aa, Homo sapiens
FPETVLAR

SEQ ID NO: 1315 - protein, 12 aa, Homo sapiens
TAATTLFQYSGK

SEQ ID NO: 1316 - protein, 15 aa, Homo sapiens
VPLQQNFQDNQFQGK

SEQ ID NO: 1317 - protein, 11 aa, Homo sapiens
SYPGLTSYLVR

SEQ ID NO: 1318 - protein, 10 aa, Homo sapiens
SYNVTSVLFR

SEQ ID NO: 1319 - protein, 19 aa, Homo sapiens
IDFSEFLSLLGDIATDYHK

SEQ ID NO: 1320 - protein, 8 aa, Homo sapiens
HLEDVFSK

SEQ ID NO: 1321 - protein, 10 aa, Homo sapiens
AIHLDLEEYR

SEQ ID NO: 1322 - protein, 11 aa, Homo sapiens
ALEQDLPVNIK

SEQ ID NO: 1323 - protein, 14 aa, Homo sapiens
GPVLAWINAVSAFR

SEQ ID NO: 1324 - protein, 10 aa, Homo sapiens
GLESTTLADK

SEQ ID NO: 1325 - protein, 15 aa, Homo sapiens
GYGYGQGAGTLSTDK

SEQ ID NO: 1326 - protein, 13 aa, Homo sapiens
LLNHYQAVPNLHK

SEQ ID NO: 1327 - protein, 11 aa, Homo sapiens
VIVVWNNIGEK

SEQ ID NO: 1328 - protein, 7 aa, Homo sapiens
YLELFQR

SEQ ID NO: 1329 - protein, 19 aa, Homo sapiens
APDELWNSLGPHPIPVIFK

SEQ ID NO: 1330 - protein, 15 aa, Homo sapiens
ELLQTELSGFLDAQK

SEQ ID NO: 1331 - protein, 8 aa, Homo sapiens
GHFDTLSK

SEQ ID NO: 1332 - protein, 7 aa, Homo sapiens
ELANTIK

SEQ ID NO: 1333 - protein, 8 aa, Homo sapiens
AAHYHTHK

SEQ ID NO: 1334 - protein, 8 aa, Homo sapiens
ELPSFLGK

SEQ ID NO: 1335 - protein, 8 aa, Homo sapiens
TDEAAFQK

SEQ ID NO: 1336 - protein, 7 aa, Homo sapiens
ELTIGSK

SEQ ID NO: 1337 - protein, 8 aa, Homo sapiens
LQDAEIAR

SEQ ID NO: 1338 - protein, 13 aa, Homo sapiens
VYIASSSGSTAIK

SEQ ID NO: 1339 - protein, 9 aa, Homo sapiens
DIAANEENR

SEQ ID NO: 1340 - protein, 18 aa, Homo sapiens
ENNAVYAFLGLTAPPGSK

SEQ ID NO: 1341 - protein, 9 aa, Homo sapiens
VGEFSGANK

SEQ ID NO: 1342 - protein, 13 aa, Homo sapiens
TAFQEALDAAGDK

SEQ ID NO: 1343 - protein, 15 aa, Homo sapiens
LVVVDFSATWCGPCK

SEQ ID NO: 1344 - protein, 8 aa, Homo sapiens
HTDVFNWK

SEQ ID NO: 1345 - protein, 10 aa, Homo sapiens
SFPEGPAVAR

SEQ ID NO: 1346 - protein, 11 aa, Homo sapiens
LGSFPSLAVAK

SEQ ID NO: 1347 - protein, 12 aa, Homo sapiens
LQFPLTFSGTVR

SEQ ID NO: 1348 - protein, 5 aa, Homo sapiens
NTFHQ

SEQ ID NO: 1349 - protein, 5 aa, Homo sapiens
PVAAE

We claim:

1. A method of detecting biomarkers in a human subject, comprising:
   assaying a biological sample obtained from the human subject, wherein the human subject has or is suspected of having a myocardial injury, and wherein the biological sample is selected from the group consisting of blood, plasma and serum; and
   detecting the biomarkers in the biological sample, wherein the biomarkers are all four biomarkers Exostosin-like 2 (EXTL2), S100A12, S100A6, and Thioredoxin (THIO).

2. The method of claim 1, further comprising detecting at least one additional biomarker in the biological sample, wherein the at least one additional biomarker is selected from the group consisting of CNDP1, CSRP1, S100A1, S100A4, SH3, and TMPRSS4.

3. The method of claim 1, wherein the biomarkers are detected by mass spectrometry, binding assay, immunoassay, antibody binding or immunohistochemistry.

4. The method of claim 1, wherein the biomarkers comprise a post-translational modification.

5. The method of claim 1, further comprising recommending a treatment for the human subject.

6. The method of claim 1, further comprising administering a treatment to the human subject.

7. The method of claim 3, wherein the immunoassay is enzyme-linked immunoassay (ELISA).

8. The method of claim 3, wherein the mass spectrometry is multiple reaction monitoring (MRM).

9. The method of claim 2, wherein the biomarkers are detected by mass spectrometry, binding assay, immunoassay, antibody binding or immunohistochemistry.

10. The method of claim 2, wherein the biomarkers comprise a post-translational modification.

11. The method of claim 2, further comprising recommending a treatment for the human subject.

12. The method of claim 2, further comprising administering a treatment to the human subject.

13. The method of claim 9, wherein the immunoassay is enzyme-linked immunoassay (ELISA).

14. The method of claim 9, wherein the mass spectrometry is multiple reaction monitoring (MRM).

15. A method of detecting at least four biomarkers in a human subject, comprising:
   assaying a biological sample obtained from the human subject,
      wherein the human subject has or is suspected of having a myocardial injury, and
      wherein the biological sample is selected from the group consisting of blood, plasma and serum; and
   detecting the at least four biomarkers in the biological sample,
      wherein the biomarkers are selected from the group consisting of Beta-Ala-His dipeptidase (CNDP1), Cysteine and glycine-rich protein 1 (CSRP1), Exostosin-like 2 (EXTL2), S100A1, S100A12, S100A4, S100A6, SH3 domain-binding glutamic acid rich-like protein (SH3), Thioredoxin (THIO), and Isoform 2 of Transmembrane protease serine 4 (TMPRSS4), and
      further wherein the at least four biomarkers are Exostosin-like 2 (EXTL2), S100A12, S100A6, and Thioredoxin (THIO).

16. The method of claim 15, wherein the biomarkers are detected by mass spectrometry, binding assay, immunoassay, antibody binding or immunohistochemistry.

17. The method of claim 15, wherein the biomarkers comprise a post-translational modification.

18. The method of claim 15, further comprising recommending a treatment for the human subject.

19. The method of claim 15, further comprising administering a treatment to the human subject.

20. The method of claim 16, wherein the immunoassay is enzyme-linked immunoassay (ELISA), and wherein the mass spectrometry is multiple reaction monitoring (MRM).

* * * * *